United States Patent 11,739,335 (NUCLEIC ACIDS ENCODING CRISPR-ASSOCIATED PROTEINS AND USES THEREOF) - sequence listing, part 10

SEQ ID NO: 7390 - RNA, 3303 nt, Artificial Sequence
  Cas9 variant
augggagcaaccauugucacagacauaucgagaagcgccuuugccuucgauauagggacgaaaagcaucggaagcgcaguacucaggcuagacgaccgaggagaaccaaucggcaucauaaacgccgccgugcgaauauacgcagacgggagagaaccaaaaagcggaacaagccuagcggaagggagacgccucgcaagaggaaugagcaggagaagggaccgauacaaacgacgaagacgcacguuacucaacacccucacagaguucgggcugaugccgcccacugacgaagcgagaaaagcccugcuagcagaaacaaaugaccgaagauucggggcaguugccggaaacgucuacgcacuccgcgcccgagcgcuagacgaaaaacuaccccuccaccacuugggccgggcccuguuccaccugaaccaaagacguggauuuaaaucaaaccgcaaaaccgacaaaagggacaacgaccaaggcaagauagccagcggcauauccaggcuaggccaaaaauuagacgaagcuggagccagaacccugggcgaguuccuccacagacaacacagcgcaggcaaguggguaagggugcgcccaucaaggguaccaucuaaagacgacaaggaagaagacggguacggguucuacccagaacgcagcuuucucgaaagggaauuugcugccauauggaaagcucaagcagcguucuaccccgaacuacugacagaggagcggggugaccaccuacaccgagugauguuuuuccaacggccacuaaagagacccaaagugggaaaaugcagcuucuacccggacgaggaccgacuccccaaagcgcacccauuguuccaagaguuccgucuaguaaaagaacuaaacgaacucgaagucguccacaggggagaccgacgagaaaaauuaacacuagaacaacgagauacccucuuuaaccaguuacgcacacagcgguccagcgcuuucacagcacugcgcaaaacacuuaaagcacccaccggaacacgauucaacaaagaaagcgaugcaagagacaaauuaaaaggagacgaagucgccgccgaaaugucacacaaagacagguucggucaggccuggauaggaaugccauuagccgaacgaugggcgguaaucgaaaugcuacuagacaccgaagacccccuagaaguuaaagcauggcucgaggagcauuacggauucgcagcagauagaaucgacgcaauagcagcagcaaaacugccaccgggauacggaagacugggcgagaccgcacuacgagacaugcuagacgaacugaagaacggcacggucaaggaugacuccggaagagacguaguucuaaccgaacgacaggcgauggacaacauauggaaggacaauccagcacuacaacgaguaguagccgacgcccgggaacuaccacccuaccaggaagugcucggaaggaggauucccccgggaaccggaaaacccgaagacccauaugacguacaaaaaggacggcucacaaaccccacaguacauaucggccuaaaccaacuaaaacgaguagucaacgcacugguacgacgccauggacggcccgaccagauagcucucgaacucgcaagggaacugaaacucaacgaagaacaaaaagccgaaaaggaccgggaaauagcccgaaacacaaaagcggcgcaagcacgaagcgaaaaacugagacaacucgacauagacgacaauggauauaacagagugcuacuaaaauuaugggaagaccugaaccuacgacaacccgagaacagggagugcauauacugcggaaaagcaauaggaaucggcacacucuucagcaaccaagucgacauagaccacauccucccguggagcaaaacacuagacgauucccaagccaaccgaauagucugccacgucgaguguaacagacagaagggaaaccacgcacccgcagaagugccacaauggcacgacagauacgaugacauacuugcaagagcagagagacuaccaagaaacaaagcauggcgcuucgggcgagaagcuaugaagaaauucaaagacgacgagagcuuccuggcaagacaacugacagacacacaauaccuaagccgcauggcccacgaguacgucgcggcccucuacccagacgaagaaccagaugaauggggagucuucacccgccgcaaccaugugagagucaucccaggaagaaugacagagaugcuccggagacaauggggacuaaacgcgauaaucuccgaucacgaccaaaagaacagaaacgaucacagacaccacgcaaucgacgcuaucgucguaggagucacgacgcggaggcuacuacagcggaucgcaacugccgcgggcggacgugaggcacuagccuuagaagaaacgauaggcaagaucgaaccaccguggccaggcuucuacgacgaugucaaagaagccaucgacaggauagucgucucacacaaacccgaccacgggucacuaccuaaaccaggagaaccggcccgaacagcaggacaacuacacaacgacaccgcauacggguuuaccggcgaagagaggaaaggcguccccauaaugguccaccggguaccauucgccacacucacagagaaagacauccccuccauacgcgacagacaacucgcagaagcgcucuacggagccauagcaggaauaucagggaaggccgaauuagccgcagcacuagcgagauuuagugcgagcggaccuuacaagggaauaaggcacgugagaguaguugagccggucucugucaucgcaauaaaagaccgcgacgguaccccauacaaaggauacaaaggagaugccaacuaccgcuacgacgucugggaacugccgaacggcaaauggacgcacgaaguagucaguauguucgacgcccacagaccagacuggcaaagcgagauccgcaacaaaaacccagccgcacgaaagguguuaagccuacaccaaaaugacauggucgcguaugaacacccacaggacggcuacacaaucggccgagucgugaaauucgggucgggcggacagauggcccuagcagggaaccgugaaggaggcgcgcucaaaucaagagacgccgaccccgaagaccgauuccgguacuucuauaaauccggaggagcaaugcgcgaugccagacuccgacagguaagaguagaugaaacagggaggguguucgacccgggaccucaggaccgcgaaucccggaacgcgcgaaaacaaucagcagcuggcuga

SEQ ID NO: 7391 - RNA, 3306 nt, Artificial Sequence
  Cas9 variant
augaagacauugggacucgaccuaggcaccaacagccucggaugggcaauaguggagacccgggacgaacccacaaaauacucugaagggagcauuguugcaagcggaguccggaucuucagccaaagcgagauggcgggcagagacccacaaagcaaggcaagccuagcaguagcccggcgacaggcacgaggaucacggcguaggagagacagauaccuaaaacgaagacaacgccucgucgaccuucucguagaucuggggcuaaugccagcagacaaggcugcacgcgcagaacuggucaaaaaccauggagacgggaagacaggggaccucucaagcagcguauacgcacucagggcccgagcucuagacgaagcccucucaccauacgaaaucggacgggcgauauuccaccuaaaccaacgacgaggauucaaaaguaaccgcaaagcagacagcaacgauccagagcagggaguaauaucagaagggaugagagcgcuggacgagaaaauggcugaagcgggagcacgaacgauaggagaauggcugcauaugcgaaggcuacaaggauugccaguacgagcaagaauagcaccagacggcgaaggguacgccuuuuaccccagccgcggcgcgcuugagagggaguucgacagaaucauggcgagacaaacccucuuccacacagaccuucugacagacacagcaauuagagaacuucgagaagugguguuccaccaacgaccacuaaggccaguaaagccaggaaaaugcuccuacaacccauuagaagaaaggcuagcgaaagcucauccacuauuccagaaguuccgacuccuaaaagaacuuaacgaacuagagauaguaggagaagaucagaaacacauaaaacuaacccccgaacagcgaaaugcauuagccuuacagcuacgcaccucccuaaccaagcaaggcaaaguccccuucaguaagcucagaagcacguuaaaacuaggcagagaaguaagauucaacaaggaaaccgacaaccgauccgaccuagaaggagacgucauauauuuccgcaugaguaggccagaauguuucggaaaccggugggccgaccuccccgucgaaaugcaagcggcgauaacagaaagacugcgaaccgagccugacuacaaaacacuaaugaacuggcucaaagcagaaacaggacuagacgaaguacacgcgagggcgguagcggacacaccgguaccggacggauucggaagacugggccagagcgcgcuaacagcacuaaucgacgcccuggagaacgagguaggugaaggcggcuucguaauaaccgaagcggaagcagcaaaacgagucuacggacgcaccaacucagaggcugacccagaccgcaaaggggucgacgaacugccuaaauaucaagagguacuggcgaggcauaucccaccuggcacgggagagccagacgacccauacgacgacuucauggggcgaaucacaaacccgacaguccacauagcucugaaccaacuaagacgaguuguaaacgcacuaauccgaacauacggcaaaccggacaggaucgcgauagaagucggcagagaccugaagaugaacgaccgcgagagagacgaaguaaaccgaagaauaggacgcaacacgaaagcagcaauagaaagaggagucaaacucacagaaacauucagacagcuagacaccggcuacaaccgccuacgacuagagcuuugggaagaccugaaccaaaaaccggaaaaccgcguaugcaucuacugugggaaagcgauugcgggccauauguuauucaacggggaaacagacaucgaucacauccugccauacucuaaaacacuagacgacuccaaagccaaccgcauccucugcugcacaucaugcaacagagaaaagaaaaaccgaccgccgagucgcgugccacaauggcgaucacgcuacggcgaaauccuagcaagagccacaacacuccccaaaaacaaacaauggagauucgcggaagacgcaaugacaagguucggggaagaagaaggauuucuugcacgccaacuaacugacaugcaauacaucucaagacuugcauuaaccuaccuagcccaccuuuacgacuacgaggaaguagaccucgacggcauauacaaacgccacgcaagagugagagcuuuaccgggcagaaugaccgagaugcuaagaaggcaauggggacuaaacgaacuucuccacgaccauaaucuaaucggaggagacgucgcaaagccuaaaaaccgccucgaccacagacaccacgcaauagacgcaaucgucauagcaugcacaagcagggcccucauccaacgcuuggccaccgcauccgcagcagccgaagaaaggggagcggaaagaguggucgaacggauagacccacccugguccggcuuccgagaagacgucagggccgcggucggagccauaguagucagucacaaaccggaccacggcacgguaggaagagaaggguaugcaaaaggcagaggacaaacagccggcaagcuacacaacgacacagccuacgggcacacaggagaaaaagacgcaagcggcaacgacauagucguaagaagaaucgcgguaaccgauaucagaucacccgcagacauaagaaaaauaagaacaaacgcccacggccacucagaacuacgggacaggcuauacgaagcaacccgcggccuggagggaaaagcguucgagcaggcagucuuagacuucguaaaaggcgaugccaaauuccgagggauacgccacguaagaaucacggagguagcgaaccccguauggauaacacacggagauggcagacacaagaaaggauaccuucccggcggaaacgaccgauucgacguuugggaacuggcggacggccgaugggacgcggaaguagugaccacauucgacgcgcacaggcccggauucguaccgagaaugcgacuggaaaaccacaacgcacgcaaaauaaugagccucaaaaagggggacaugauagcguacaacgaccccgugaguggacaacgaauaauagccaucguuagaaaauucgaccagaggaacaaacaacuauaccuagacccccacaacgaagccgggaaucuggaccggagagaaaaagagaaaaccuauaaaccacucagacccaugccaaacccacucaagaaguaccgaccccggcaggucaggaucgacgagaucggucagguguucgacccaggaccguggugggagcgacaagacgguuga

SEQ ID NO: 7392 - RNA, 3306 nt, Artificial Sequence
  Cas9 variant
auggaacaaaccucauuagaccuaucacaggcaaugaaaaagguggcccaaccccaaaaacccuaccgccugggcgucgacguagguguggcgucuauaggagcagcagccgucacagacacggaaauucuagggauacacguccguaccuucgaaaaaggggaaaucaauggaaagucaggacgcaaaccccucaacgccgacuacaggagacagaaaggacaacgcaaacgucuucgacgcaagaaaaacagacuacuuucucuacgacggcuauuccgacgugucggaaugaucgaauccgcugccauagaagcguucccuaucuccucgaccagcccauggcaacucaggaccgagggucuagaccgccgacucacaaacgaggaaugggcccaaguccuauaccacauagcgaaacaccgaggcuuccaaagcaaccgaagaguggauauggacgaggccacaaaacucagcgacgcagccggagacucccccgaaacaacgaccaacaccgaaagugacagcgauacuaagaaaaugcuggcggggguggccgacaacaaacgucuccucgcagaaaaaggcuaucguacgauaggagaagcgguagcacgcgaccccaaauucucccaccggauacgaaacaaagaggagagcuacucccacaccauuggccgagacgaaaucaacgcggaacuuaacugccucuuccaagcccaaaaccacuacggcaacccacacgccaccgaagaacuaagugaacaaaucauagaccuaaucaacuggaggcggaaaaccgugaccggcgacgacauaaagcggaugguaggccgcugcacacuagaacccaaggaauacagagccgcaauccacuccguaucugccgaggaguuccgguggcucuccacgcucagccgccuacgcauaguaacccagggagaaucaagaccauuaacaaaaugcgaaugggacaaaguagucgaccuccccuggcgacaagaagcaaucaccuacacgucaauacgaaacgcuaucggacuucgacacgauaucaggucacgcuucaacauucgauacgaaaccggcggaaagaaaaccaagacggacaccaaaaacgagacaaccaaaggccaaagcgcggacgcggucaccuccgaagucaaaacagccgaaaaggaaacagccuucaaggcaaaaggauaccauauucugcggaaagcauacaaggccuucggcuacgacgaacaaugggacagagaccgcuucaacacugaacuccucgacacccucgcaacggcagucaccuucuacaaagacgacuccgaaauacaagcucaccuagagaccaacgacacaccagaauacgcaauccaaauagcacuacgacuacccacccucacaaaguuuaguaagcuaagcaacaaagcaauacuuaaaauacucccccacaugcgcgaacggcaaucauacucaaaugccugccuucucgcgggcuacaaaaaucaccacaagcaauaugacgauacaccccaaaauggcaaaaucccucggagcgcgauagaacacaucaagaacacagucguguacaggagccuaaaccaggcccgacgcgucauaaacgccaugguuaaagaguacggcgccccacaggaaguccacauugaauuagcccgggacauggagaaauccgcgaaaaagaaagacgaaaucgaccucuggaugaagaaacgcaaaaagaaaaacgacgaacucagagaacgauucggcaaaaaccucagccgcgacgaacuccuaaaauacaaacucuacgaggaacagaauggacaaugcgcauauagucuccaaccaauucaacucggccggcuccuggagcccaacuacguagaaguagaccacgcccuaccgcgcagcaggaguauggacaauuccuacaacaauaaagugcucguacuaaccaaacagaaccgagacaaaggcgaccguaccccauucgaguacuucggcgaagaccaggaaucaguagauuggaaacgcuucaccaacugggucgagucgaacccccaaaugccccaagccaaacgacgaaaacuccuaaccaaaucccuccaaaaaggcauauuggacaacuucagcgcacgcaaucuuagcgauacacgguacaucgcucgcgaauugaaaacccuuaucgagcacuacauacucaacaccccagaacgcgagaaaacaaaauacgaacgaugcgucguaaucagcggaaaacucaccgcccaaaugcgucaacugugggggauaagcaaggcaagagacgugagugaccgacaucacggauccgacgccgcggucaucgcuugcaucacucccagcaugguacgacgaaucacacgcuaccuacaacuccaagaaaggagagcaaugcccagcgcccccgggaagggugacgaacaccccgcagucgucgcacgcgcgaucccccacgccccaguccccuggcccacauucgaacacgaccucgaagcagcccuagaaaaaguccucgucucacgaccacaaucccggaaaugguccggccccauccacgcagacaccaucuacggcgaacacaaagaccaggaaacgaacacgguagccccaacacaacgcaucaagcuaacccaacuaaccaagucaaacuacaaaaacauagucggauacgacgaagaaaggaacaaggacuucauagaccaaaucgaggaacggcuugaaugccauaacuucaacggaaaacaagccuuuggaacaucacaguccccuaucuaucgaauaaagaaaaacggagaacuaggacccgaagucaagaaaguaaccaucaaacucccaaucaaaaacucggucuuccgcauacgccgcggcuacgucaaaaacgccaaaaacucaaccauauacauaaacauauaucaaaacacgaaaaccgggaaauucgagaugcacccagucuacgcaaaagacuuaacaucgagugcgaacgccaguaagagcuucgaauacucccccgaccuacagcuaguagacacaauccgacggggagacuacauagagaucacccgcagaaacggcgaagucauaucaggauacuacgcuacccacaacauaagcacgucaguucucgagcuccaaccccaugacacaacagacucccggaacaaccgaacacccgccauaaaaacaagccucaacaucgagcgauuccacaucgauauccucggccgcaaacgcagggugguaagacgagccaaaaacggacuagcagacgacagagacaaauga

SEQ ID NO: 7393 - RNA, 3309 nt, Artificial Sequence
  Cas9 variant
augggcuaccgcaucggccuggacaucggcaucaccagcgugggauacgccauccucaagaccgacgagaagggcucccccuacaagaucgagcaccugacgagcgucauauucccgaucgccgagaacccaaaggacgggaagucccucgcgaugccccggcgcgagcagcggggcgcccgcaggcgcaaccggcgcaccaaguuccggaaacaccgcaccaagaugcuguucgugcggagcgagcuccugaccaucaagcagauugaggccauauacuccgagaagcagaaacucagcuccaucuacgagcugcgcacuaaggcccugaacgagcggcucaccaacgaggagcuguuccgcauccuguacuucuucagcggccaccggggguucaaguccaaccgcaagagcgagcucaccgagaaggacaugggccccgugcugaccgccaucaaggacaucgaggagaagcuggcggacgggacguaccggacccucggcgaguacauggaauuagaugagaaguaccaggagcacaagcgcaacaaggacgggauagaccgguaccugggcaccgccaagcggucccucaucgaggacgagaucaagcagaucaucaucgcccagcagcaguucggcaacaccaagcugacgagcggguuccaggucgccuucaucggugacgaggagcagaccgggaucuucaacgaccagcgggaguucgaggacggcccgggcaagcagucccccuacgcggggaaccagaucgagaagaugaucggcgccugcaccuucgaggagaacgagaagcgcgcucccaaggccagcuacaccuuccaauacuucgacuuccugugcaagcucaacaaccugaaguaccgcgagacgaucggcggggaguaucgguuccuguccuuagagcagaagaacgugcugaaggagaaagugcugaccacccagaagauaaccuucagcggcgucaagaagcuccuugaccugcccgagcacgcccaguucaaccucgugaacuacggcacgaaauccaccgugaaggagaccgagacuaagagcgucuucuacgcgaugaucuccuaccacaagcugaagaaggccaucccggcgcccaucuuuucaaaccugagcacggccgaguuggacgagaucggccgcauccugacccuguacuccagcgacaaggggcggaagaacgaguucuacucucgccucgccauccccgaggaggugguggaggcgcuacugcccaucaacuucuccaaguucggcaaccucucccugaaggccaugcggaagaucaucccguaccuggagauggggcucgucuacagcgaggccgcaacccaggccggcuacgacuuccgccacaagaagauugaccaggcguacauccacgaaaacgugaccaaccccguggucaagcgggccgccucccagacgauaaagaucgugaacaacaucauccgcaaguacggggagcccgacggcaucaacaucgaguuagcccgggagcugagcaagaacuucuccgagcgcaagaagaccgugaaguaccaggaggagaaccgcgcccgcaacgagcggaucgcggacaagcucagagagugcgagcugcccgucaacggugccaacaucacccggcugaagcuguucgaggagcagggggaguucgacccguacaccggccucaagauccccuucgaccgcgccuucagcgaggaguacgagguggaccacauaauccccuacuccaagacgcuggacgacagcuacgggaacaagauccucgugagcgccaaggcgaaccaggagaagggcaaccggauccccauggaguaccuccaggggaagccggagcgcaucaagaagcuggagagcaucaccgccaccaucaagaaccccaagaagcgggagaagcugcucaagcagcagcugaccaaggaggacgucgacggcuggaaaacgagaaacuugaacgacacccgcuacaucucgagccuccugcacgacuacuucaaccagaacaucuccuucgccaagcuggagagcgagaagaagaagagggugauugccgugaacggcgccaucaccuccaaguugagggcgcgguggggguucaacaagauccgcgagaacggcgacgagcaccacgcccuggacgcccugaucgucgccugcgugaccgacaaguacaucaaggagaucaccagcuucagcaagcggaaggagguccgcuucaacgagaaccucuggaagcgggagaagacgccccaggagaucgagcaggagguggugcacuucaagaaggacuacgaccgcaucuucaaccaggccuucccccugccguggaccaacuuccgggaggaggucuccugccgcaugagcgagaaccccgcggagcugaugaagaaccacaccugggagaccuacacggacgacgagaucgccgcgcucaggcccaucuucaucgugcgcaugcccaacaugaagaccuccggucccgcccaccaggagaccauccggagcggcaagcuggaggagaagggcuugaacaucagucgcgugagcaucgagaagcucaagcuggacaaggagggcaccaucaagucaggcaacgcccaguucuacaaggacagcgggaacggcuggcagcuguugcacgauaagcugaaagucgcgcuggagaagcacgacggggacggcuccaaggccuuccccgacggcgucuucaaguaccaguaccucgacaaggagcacacggugaggaagguccgcuuaguggccaagagcacucugcagaccucccucaacgagaagaaguccguggccgacaacgggagcaugauccggaucgacgucuuccgcaacgagcagggaaaguaccaguucgugcccaucuacgcgaaggaccgcguggccaaaaagcugccgaaccaggccguugccguggggaagaucgccaaggaguggccccugaucgaggagagcgacuucaaguucucccucuacagcaacgaccugauccgcgugaagcacaagaagggcgucaagcacguguccaaggacgggaacaaggaggagaaguccaagaccgacuucuucggcuacuacacgggcgcggacaucgccaccgccagcaucagcgggaucagccccaacaacuucuucgaguuccgguccaugggccuggccacccucaucagcaucgaaaaguacaagguggacuacuucgggaacuaccaccaggucaacgagaaggugcgccagaaauuccccaagaaccgcauguga

SEQ ID NO: 7394 - RNA, 3312 nt, Artificial Sequence; identical to SEQ ID NO: 1594
  Cas9 variant

SEQ ID NO: 7395 - RNA, 3315 nt, Artificial Sequence; identical to SEQ ID NO: 1595
  Cas9 variant

SEQ ID NO: 7396 - RNA, 3315 nt, Artificial Sequence
  Cas9 variant
augaaccacuacgugcugggccucgacaucgggaucaccagcgucggcuacggagugaucgaccuugacaacuaccaguucguggacuacggcguacgccuguucaaggaggggaccgccgaggacaacgugaaccggcgcacgaagcggggcagucgccgguuaaagcgcaggaggcagacccggcuggacgacaugaaggagcugcuccaaaaggagaagaucaugagcgagaccuaccacuccagcuacgaccccuacgacaugcgcaucaaaggccugucccagaagcugagcaacgacgagcugacuugcgccauccugcacaucacgaagugccgggggaccacccuggaggcgcucgacuccgccgacgaggacagcgaaggcaccaaguccauccugagcaagaacgaccaggaccugaagaaguaccacuacgugugccucguccagaaggagcgccugaagcaguccgggaagauccggggcacggagaacaacuucaagacagacgacuacaucaaggagcuggaugagauccucagccaccaggaccuguccgaggaccugugugaaaagauccgcaccaucgugagccgccgccggcaguacuacgaggggccgggcuccgagaagucccccacacccuacggccgcuggaucgcccaggggguggcccccaucgaccucaucgagaagaugcggggcaagugcagcgucuucccggaccagcugcgcgccgcgaagaacagcuacacggccgagcuguucaaccuccugaacgaccugaacaaccucgagugcgagggggagaagcugacgaccucccagaaacaggacgugaucgacuucgugaacgagaagggcggcaucacccccaagcagcuggccaagcugcugaacgucgaccucaaccagaucaagggauuccggaucgacaagaacgacaagccccuccugacggaguucaagggcuacaaggccuucaagaaaaucuucgacaccaacaacugugaccuguacaagaaggaccucuccauccuggacggguuagcggagauugugaccggcaagaaggggaucgaggagcgcaagcaggccauccagcaggccuaccccgagaucgacgaggccaucguggagcagugcgccgucaugaagggcaugacccaguaccacagccucucccugaaggcgaugcaccugaucaaccaggagaugcuccagagcccgcgcaaccagaugcagguccugcacgagucccacguguucgacaagaaccgggugagccacaaaggccagaaguacaucgaagccgacgacgaggccauccugucccccguggugaagcgcgcccagcgggagacguucaaggucgugaacgcccuacgcgagaaguauggggaguucgagagcaucguggucgagaccacccgggacagaaacucccaggagcagaagaagcggcugaacgacagccagaaguacuacgagcaggagaaccgcaagguggacgagcugcucucccacgagggcuacgaccccagcaaaaucaacgggaagacuaagcugaagguccggcuguaccugcagcaggagggcaagacggcguacaccaacgcccccaucgaccucaaccugcugaucaaggacgccacugccuacgagguggaccacaucaucccgcucuccauaagccuggacgacuccaucaacaacaaggcccugaucaaccgcaccgagaaccagaacaagagcaacaugacgcccaucuacgcgauccuccgggggaagcugaacauuucccuggauaccuacaagaccguggucaagaacaaccgcaacuacaccggcaagaagcggagcuaccuccuguacgacaaggacaucacgaaguucaguaacaugcaggaguucaucgccaggaaccugguggacaccagcuacgcaugccggguggucauguccacccucagcgacuacuucaaggacaacgagaucagcacccacgugcacacggugcgcggccggguuaccaacauguuccgcaaccggaucaacaugcagaaggagcgcgagaaggacuaccugcaccacgccguggacgcccugaucguggcgaguaucaagaaacucaaccugcugaacaccuaccuccugaaguacaacuucaacgaccuguacaacgaggagaccggggaggucuucgccgugggcgacgaccagcagguccucgaccccaaguacauccgauuuaucacccagcugaagacgaucuacgacgagagcaacauguacuacaacgggcugaucgagcggaacgugaugcaguucccgcccaucaagaucucccacaagaucgacaccaagcccaaccgccaaaucagcgacgagaccaucuauuccacccggacggucggcaacgaggaguacguggucaagaaguacagcgacaucuacgaccccaaguucacccagcucaccgacgacaucaucaacgaccgcccccuggacagguggcugauguaccgcaacgacaaccagaccuucaagaucauccaguccaucauucucgaccacuuccauaucuucaaggacgacgagaagcacuacagcugcacgaagaagaaggggcagauccaguacgcccugaagggcaagaacccgcuguaccucuacaagcaggagcacgguaaggugcggaaguacgccaagaaggggaacggccccgagaucaccaugaugaaguacuucgacgggaagcugggcaacaacaucgauaucuccaaccacuaccacgugcacaacaaaaagguagugcugcuccagaucagccccuaccgcaccgacuucuaugugucacccgagggcaaguacaagaugcugaccguccgguaugcgaacguguucuacaaggagagcaagaagaaguacgugauagacgagaagugguacgccuccgagaagaagcgcaagaacaucacggacgacgacaucuucgucugcagccugcaccacgacgaacucaucgggauccagaagaaggacggcgccaaguacguguacgaccuguccaccgaggacgguggcaagccgcggcuguaccacggggagauggagauccucaaguucaccgccaccaauaacgacagcaagaacaucaucgaggugaagcccaucuacacguauugcaagaaacagcugaugaucuccaucggccccaucaccaagcuggccaaguacgcgaccgacguccucggcaacguguacgaggugaagaagaacaucaucgaccaccugagccaccuguga

SEQ ID NO: 7397 - RNA, 3318 nt, Artificial Sequence
  Cas9 variant
augggcauccgcaucgggcuggacaucgggaucgccagcguggggugggccgucguggacgacgacuacaacaucaucgaguccggcgcgaacaucuucaacgaggccaaggcagccagcaacguggaccggcgcacguuucgucagaccaagagacuccugcggcgccagaagacgcggcugcgcgacuuugacauccucuggaucaacgccgggcuggacauccccaaggagaaggucaacaagcagcugcaguuccgggugcagggcaugaccauggagcucuccgagaacgaacuguacgcggcgcugaagaacaugcucaaacaccgcggcaucagcuaccuggaggacgcccuggacgaggagcaguccggcaagagcaccuacgagaaggggcuccaggugaaccagaaggcccuuaagugcgacaagaugccgugcgaaauccaguacgagcggcugaugaaguacggguccuaccgcggccacaucgaggucaaggacgagagcggggaggagaugauccucuccaacaucuucacccuggacgcguacugcaaggaggccaagaagauucuggagugccagaagcaguaccacagcuucaucacggaggccuucgaggacgacuaccucgcccugcugcggcgcaagcggaaguacuacgagggccccgggaacgagcagucccgcaccgacuacgggaaguacaccaccaagcucaaccccgagacgggcgaguacgugaccgaggagaacaucuucgagaagcugaucgggaagugcagcguguaccccaaggaaaugcgggccuccgcggccagcuacaccgcccagaucuacaacaugcugaacgaccucaacaaccugaccaucaacggccgcaaacuggaguacgaggagaagaaguccaucgucgaggaggugcagaaggccagcuccgugaacaugcucaagaucaucaagaaggucaucaacgaggacaucacgaccaucgagggcgcccggaaggacaagaacgacaaggagaucuuccacaagauggagacuuacaacaaaaugcgccacuacuucgagaagaacggacuggaguucaagaaaaucagcaccgacgaccuggacgagaucggcaacauccucacgcugaacaccgagaaggaggcgauccuggaggccuucaacaagucccagcucgagcugagccaggaggagaaggaggccuucaucgagauccggaagaagaacgggagccuguucaacaaguggcacuccuucucacucaagaucaugaaggagcugaucccggagcuguaccuccaguccaagaaccagaugcagcugcugaccgacaugggcguguucaagaagaagaccgagaucuuccagaacuacgacaagauccccacggacgugaucaucgaggacaucuacaaccccgucgugaagcgcagcauccguaucaccgugaagaucgucaacgcucucaucaagaaguacggguauccccgggagguggugaucgagaugccgagggaccggaacuccgacgaagagaagaagcgcauccaggacgagcagaagaagaaugauaccgagcugaagaagaucaucgagaaggucgagagcgaguacggcaucaagaucaccgacacgcacuuccggaaccacaagaaccugcgcaugaagcuccggcuguggcacgagcaggacggccgcugccuguacuccgggaaggugaucgauaucagcgagcuccugaacgacugcuccaaguucgagaucgaccacgugauccccaagagcaucuccuucgacgacagccgguccaacaagguccugguauacagcaccgagaaccagaagaagaccaaccagacgcccuaccaguaccuggagggaaacgggaaggagugguccuucgacgaguacaugaaccaggucaucgagcucaaggaccgcaagcugaucagcaaggccaagaugaacaagcuccuguuucgggaggacaucacgaagaucgaggugcugaagggcuucaucgcgcgcaacauaaacgacacacgguacgccucccgcgugguccugaacagcuuccagaaguacuucgaguccaagcagagcgacaccaaggugaagguuauccgggggagcuucacccaccagaugcgcaagaagcuccagcuguccaagaaucgggacgagagcuacgcccaccacgccgucgacgccaugcugauaugcuacucccagaugggcuacgaggcauaccgccagcuccaggaggaccugaucgaccccgacagcgagaagauccgggaccugggccucuggaaggagacgaucaccgaggcuaaguacgacgaggugcuguacaccgccaaguggcuggagaaccgcgggaagauccaggaggccgagaagaaggugaaguucuggcacaaggucgacuccaaggcgaaccgcgcccucugcaaccagaccauccggggcacgagggugaucgacgggagcauccagaagaucaacaagaucaacaucuacuccguggacggcuacaagaccuucaagaacaugauccagaaggggaaggagaaggacuuccugauguaccggaacgaccgccggagcugggacgaccugaugaaggucuaccgcgaguacuccgacgccaagaacgccuucgccgcguaccaggaggagacuggcgacuacgugcggaaguacgccaagaagcacaauggcagcaagaucaccaaccucaaguacugcgccaaggagcugggguccugcaucgacaucagccacaaguacggccuggagaaggacucccgcaaggugauccucgagagccuguccccguaccggagcgacgucuacuacaacgccggccugaagcaauacuacaucgugggcaucaagaacuccgaccuaugcuuccugaagggcgaguacuucaucgacagcaagcgcuaccugcagauccuccgggaggagggggugcugaccgagcagcacacgcugaacgacuuagccgcaaucggcaccgaguuccaguucagccuguacgagaacgacuaccuggaguacgagaagaacggggagaucaagaccgagcgcuuccucucccggaccaagcccaagcagaagaacuacaucgagaccaagagcaucgacgccccuaagaucaagaacaagaagcagaaccuggucggccuggccaaguccaagucuaucaagaagauccgcgucgacauccucgggaaccguuacuacgcuuccaaagagaaguucagccugauggucgacaaguucuga

SEQ ID NO: 7398 - RNA, 3318 nt, Artificial Sequence
  Cas9 variant
auggacauggccuggcgccucggacuugaccucggaacgaacucacucggaugggcggcccuaucgcuagacgcagcgggggcuccagacgcaauccuagcagcggguagccgcaucuucggagacggacgagacccccagagcgggacaucucucgcagucgaucgucgggccgcgcgagcagcacgacgcaggcgcgaccgauucaaacagcgucagcgcgcacuacugaaacaucucgaggccgacggccuauucccagcagacccagagguacagcaggcgcuagcagcccuugacccauacgcguuaagagcacgagccuuagaugaggcacuuagccuacaugaaaucggcagagcccucuuucaccucaaccagagacggggauuccaaagcaacagaaaagccgacaggggcaaggacgaggacgccggaaagaucgccauaggagucgaccgacuaaaagaugcgaucgccgccgccggugcaaggaccuuuggcgaguuccugcgccaacgacgagcaggcgccaccggugaaaaccagauaccauccguccgcacacgccuacgcgcagagaccggcgagggcgcaaagggaagcgguuacgacuucuauccaagccgagcccuccuaaaggacgaauuugacgcgauauggcacgcacaagcagaacaccacccaaaaguacucacagacgaagccuaccacagguuacacgagauuguauuccgccaacguccgcucagagcaccaaaaguaggggcgugcacgcuuguaccaggggaggcaagacuacccaaggcccaccccuuguuccagcgcaggagacuucuagaagaacucaacgcccucaugauaguacgcgcaggcgccguagcggaaagacuaaccccagagcaacgcgaccuccuccuccuuaaacucaaggacaagggaaaagucacauucaaaucauuacgagagaaagugcugaaacucgacggagacgcaagauucaauaaagaauccgagcauagaaccgaacucaaaggagacgagguugcagcggaaaugggcggcaaaacaagauuugggagucuauggccccaucucagcaccgaacaacaguggaccguuauagaacgacaacaggcacucgaaagcgacgcagacgaagcagccuuccgaacauggcucguggaaacccacaaacucacagcugaacaagcacgcgcgguagccggcgcccgacuaccggcaggacacggcagguuuggccuaacagcgacagcagcacuucuugccgcgcuccgggacggacgcacacccgaaggacggggcccaaacgcaccagcaaccgaagcagggagagugguagucuacagcgaagcggccgcgaucgcaggauaucaccacagcgaccaccgauccggagaaguauucacagaugcgaaaggaagaccagcacuaccauacuacggcgucccccuagacaggcacaucguaccuggaacagccgacccggacgaacccgacgaagcggcucggauaggacguuugaccaaccccacgguccauauagcacuaaaccaauuacgaagagugguaaacaggcuaauacgcguguacggcccgccggcagaagucgcgcuagaacuagcaagggaacucaagcugucggaagacgaaaagaaagaacgcaacagagaaaacucaaggaaccguuuagacgcagagaaaagaucaagcaaacuagccgagcuggggcagagagauaauggcggaaaccgcgcccuucuaaaauugugggaagaacuaaaccccgaaaacauacuagaccgccgaugcauauacucuggaagacaaaucagcaucgguaugauauuuucgggcgcagcggaagucgaccacauacuaccauucgacgcaacgcuagacgacucgaaugcaaacaaaauccugugccuaagagaagccaaccgcgacaaacgcaaaagaucacccuucgaggccuggggcgggacuccgcaaugggaagaaauagcagaaagggccaguagauugccaaggaacaaacgauggagguucgaaccggacgcaauggaacgauucgccgaagaaggaggguuccuugcgagacaccucgucgacacacaauaccucggaagaaucgcucacgacuaccuaagaugucuauacccggauaagggcgacggcucgagccacgucugggucuccccaggacgacuaaccgagauggugcgcaggaagcuaggccuaaacggccuccuaggcgaccacaaccucggcgcugaacaacccaaaaaccgcaaagaccaccgacaccaugcaauugacgccguagucacagccauucuagaccgaaguaugcugcagcgcauacagcgagcaucaggagagggagccagugacgcggaacuccugagaaucauagucccggaaccauggacaggauuccgagacgaccuacaacgggccgucgaccgcaucguuguggcgcaccgggcggaccacggcaccguagcaaaggcagcaacaagagggagagaccaaaccgccgcaagacuccacaacgacaccgcauauggcuucacaggcgaagcagacgcgaagggcacaccaauagucgugcaccgcgcaccccucggggcccuaaagaaacccgagcacauagaccaagucagggacccacugcuaagagcggcccuccacgacuucacggccggccuaucaggcaaacccuuugaagaccguauagccgcguucccccgccuagguccguuggacuaccggggcaucagacgaguaagagucguagagccccuacaagucaucccaauacgcgacgccgccggacgggccuacaaaggauacaaaggcgauagcaacuaccgauaugacguaugggaacugcccgacggcaagugggaacaacgaguccuacagauguacuacgcccaccaaagcggggaaccaccaagaccccacccagcagcgcgaaaaguccugucccugcacagggaugacguacuagccauagaacgaggcgaaggcgggcgggaacugguaagaguagucaaauucuccaccaaugaauuuaccuuagcaccacuaaacgaagguggggcgcugaaaagccgucacgcagacaaaggagaucccuucagguaccuauacccaucacccagcacacuaaaggcauggagagccagagaaguacgcgucgacgaacuaggacgaguacuagacccaggauucccggcaaggaagcggcgccgcgucacaagaccagggcgagcagacgcagacuga

SEQ ID NO: 7399 - RNA, 3321 nt, Artificial Sequence
  Cas9 variant
augcaguacaucguggcaaucgacaucggcgucgccagcgugggguacgcggugaucgacaagaccuccgagaccgucaucgaggccggcagcaacaucuuccccgaggccuccgccacggacaaccaggagcgccgggggaugcgccaggcccggcgccugaagcggcgcgagcggacccgccucgacgacuucaccaagcugugggaauaccacggccuggcgaucccccaggugaagaagaacgacaucguggggcucaaggucaaggcccuguacgagagcaucuccuuggacgagguguaccucauccuguacucauaccugaagcaccggggcaucuccuaccucgaggauguggaggacagcuccgucagcggauccaccgccuacgccaacgggcugaagcugaacgcgaaggaguuagagaagaacuucccgugcgagauccagaaguaccgccuggagaacaucggcaaauaccgggggcagauccagaucgaggacgaccagggcgagaagcuggaccucagcaacguguucacgauaggggccuacaccaaggagauacagcagauacuggacacccagaagaaguaccacgcagagaucgaggacgaguucugcgagaaguaccugaagaucuucacccgcaagcguaaguacuacgagggccccggcaacgagaagucccgcacggacuacgggaaguacaccacccggcucaaggagaacggcgaauacaucaccgagaagaacaucuucgagaagcugaucgggaagugcagcguguacaaggaugagcugcgcgccgccuccgcgagcuacacggcccaggaguucaaccuccugaacgaccugaacaaccucaccgucaacggccggaagcuggaagagaacgagaagcaccugauaguggacaaggugaagaccuccaacaccaucaacaugcgcaagaucaucgccgacgccaugggcgagaagaucgaggaguucuacggcgcccggaucgacaagagugagaaggagaucuuccacaaguucgaggucuacaacaagaugcgcaaggcgcucgccgccauccacgugaacaucgaggaguucucccgggacgaccuggacgagauaggcuacauccugacgaucaacacagacaaggaggccaugauggaggccuuugacaacagccgccucgagcugcccggggagaucaagaacugccugaucucccuccgcaagaccaacggcacccuguacuccaaguggcauagcuucucccugaagaucaugaacgagcucaucccggagauguaccggcagcccaaggaacagaugacgcugcugaccgagaugggggugaugaagggccagacggacgaguucgaaaagaacaaguacauccccgucgacguggcgagcgaggacaucuuuaaccccgugguccgccgguccgugcgcaucagcuucaagauccucaacgcccuaaugaagaaguacggcacucuggacgagguggucaucgagaugccgcgggaccgcaacuccgacgagcagaagaagugggagaaggagacacagaagaagaacgagaaggagcaggaguacaucgagaacaagcucgccaccguguacgacauccggcugagcuccgccgacuucagcucccagaagcagcugaaccucaagcugaagcuguggaacgagcaggacgggaagugccucuacagcggcaagaucaucgagcccgaggaccugaucaagcacuccgagcuguucgagaucgaccacaucaucccccgcagcaucucuuucgacgacucgcgguccaacaaggugcugguguaccgcaccgagaaccagaacaaggggaaccagacccccuacuacuacuuaacgcacacaaacagcaagugguccuucgagcaguacaaggcccuggugauggaccugagcaagaagaaggaguacggccucagcaagaagaagguccggaaccugcuguacuccgaggacaucaccaaggcggacgugcuccgcggguucaucaaccggaacaucaaugacaccagcuacgcagcccgcgugguccugaacacggugcagggcuacuuucgggccaaggagaugggcaccaaggucaaggucauccgcggguccuacacccaccagaugcgggugaacaugaagcuggacaaggaccgcgagaaguccuacgcgcaccacgccguggacgccaugcucaucgccuucagccagcugggguacgaggccuaccggaagcugcagggagaguucauagacuucgagaccggcgagauccucaacagcgagaaguggaaggaucagauguccgacgaggucuacaaacaguaccuguaccgcaagaaguggagcaacauccgcaacgagaucacgcgggcggaaaagaacgugaaguacugguacuacguggaccacaaguccaaccgugggcugugcaaccagaagauccggggcacccgcgucuaugacggcaagaucuacaaaaucaacaagcucgacauccggaagaaggagggugcggcccuuuucaagaagcuggccuucagcgagaaggaguccgaccgcgagaagcuccugguguacaagaacgacaagaagaccuacgaagaccuggugaggaucaugcaggacuauagcgacuccaagaacccguucguccaguacgagaaggagaccggcgacuacgugcgcaaauacgcgaagaagcacaacgggccccgaaucgacaagcucaaguacaucgacggcgaggugggcagcugcaucgacaucucccacaaguacggguacgagaagggcagccgcaaggucgugcuggagucccuggugcccuaccggauggacgucuacuacaagaaggaggagcagaccuacuaccucguggggaucaagcagagcgacgugaagugccagaagggcgaguacgucauagacgaggacgcuuaugcuaucaaccuggugaaggagaagaugauccagcaggggcagaagcgcagcgaccuggagucccucggcuucgaguuucagcugagcuucuacaagaacgacaucaucgaguacgagaaggacggcaagaucgugcgggagcgcuuccugucccggacaaugcccaaggucaagaacuacaucgagaccaagccgaucgaccgcgccaaguacgaguggcacgaccggaagcucguggggcugggcaagaccaagcgcauccggaaguaccgcauggacauccuggggaacuacuaccucugcaacaaggaggaguucagcaaguacugcuga

SEQ ID NO: 7400 - RNA, 3324 nt, Artificial Sequence; identical to SEQ ID NO: 1600
  Cas9 variant

SEQ ID NO: 7401 - RNA, 3324 nt, Artificial Sequence
  Cas9 variant
augggcuacacccuggggcucgacaucggcaucgccagcgugggguucggccugauagacaacgucgacgggaagauccuggaguccggcgugcgccucuucagcuccgcugaccccgacaacaaccagaccagacgcucaagucggcaggcgcgccggcugaaccgccggaaggugcaccgccuggagcgggucgcccaccuccuggaggaggccggcuucgagaagggggaggugcuggcccccacucccuaccaucuccgcgucaagggccugaccgagaagcugagcaagccagaggucuacgccgcacucuacaaccugaugaagcaccgggggaucuccuaccuagaggacguggagcuagacgaagccgacagcuccagcgugucccagaacgucgagcugcugaaggaguacuaccccugcgagauccagcucgagcgcuacgaggaguacggccagauccgggggauuaucgagacguacaacaaggauggcgagaaggagagccuggugaacaucuucccgaccggcgccuacaagaaggaggccgaagcgaucauccugaagcaggggcaguucuaccccgagcucgacaagguguuccuggagaaguucaccgagauccugaccgucaagcgccccuacuacgugggccccgggaacaagaagucccggaccgacuacggcaucuaccgcgagaacggcgagacccuggagaaccuguucgacauccugauugguaagugcacgaucuacccgcaggaggcccgggccgccaaguucagcuacaccgcacagcuguucgacuuccugaacgacaugaacaacaucuccaucgccggcgagaagcugaccgaggugcagaagcgcgagaucuaccaccagaucaugagcuccaagaccgucaacaugaugaagaucaucacgaaggugaccgggugccucaaggaggaagugaccggcuaccgggucgacagcaaguacaaggccgaguuccacuccuucgccagcuaccgccaguuccggaacaagaugcuggacuacggauucgacgugcagacccugaacguggagauguucgacaagcucgccgccaagcugacgcugaacaccgaguaccaccagaucaucacccagcucgaaagccugaaccugggccucuccaaggagcugaucgagaagaucgcagacuuccgcaagaagaaucgcagccuguucuccaaguggcacagccucucccugaaggccaugaacgaggucguggacgagcuguggagcaccuccaagaaucagaugcagaucuucagcgagcucggcggguucaaguccaacaucgagguguucaagggccugaaguacaucccccuggacgccauggucgacgagaucuacaaccccgugguccggugcagcauccgcgaguccaucaagaucauuaacgcccuccugaagaaguacggggcccuggacaagguggugaucgagaugcccagagacagcaacgagaaggaggagaaggaccgcaucacgaagcugaacaaggagaacgacaacaagaagaagcaggcgaucgagaaggcccggaacgaauacggcuucggggaggaggccuaccgccagcagaacgaccucaacaccaagcugcggcugugguaugagcagaagcagcgcugccucuacuccggcgagaucaucaagaucuucgaccugaucaagaacccgcaccuguucgacaucgaccacaucauccccaagagcaucuccuacgacgacagccucuccaacaagguccugugcuacgccaccgagaaccgggagaagggcaaccugaccccguaccgcuacuucaagcggaaggccagccucacguggaacuaugaggcguacaaguccuacgugaucgaacuguacaaggacgggaagggcgaccugagccgcaccaagcucgagcugcuacucuucgaagaggacaucaacaaguacgaggugcggcagcgcuucaucaaccggaaccuggucgacacccgcuacgccagcaagguggugcugaacacccuccaggacuucaugaaggagaacuaccccacgacuaccguagagguggugcgcgggaaguucaccgcccaacugcgacggcacuggggcauccgcaagaaccgcgacgagaaccacgcccaccacgccaucgacgcucugaucaucgccugcgucccgcaccucucccuguggaaggagcagaagaagguguucagcacggacgaguuccggguggacgagaccaccggggagaucauugagcaguccuacaaccagcugaccuaccaggagcccuucagccaguucuucuaccagcucgagaaggucuccaucgauugccgcuacagcuauaagguggaccggaaguucaaucgccagguggccgacgcgacgaucuacuccacgcggcagggaaucgucaagcagaccagcggcgacaaguccuucacccuggacuccaacuccaaggagcacuacgugaucgcaaagaucaagaacaucuacgaggacguggacgccaagcgcuucauggaccgguacaagaaggacaagacccaguuccugauguaccaccacgacccccagacguucagcauccucgaggacgucaugaagaccuaccccgacaagaagaacccguuccaggccuaccgccuggaguacgggcccauccggaaguacuccaagaagggcaacgggccccagauccagagcaucaaguacuacgacuccaagcugggucagcacaucgagcucaagcaggcuaaccagagcaccaagaaggugguacugcagucccugaaccccuggcgcugcgacaucuacuacaacaagaaggacaagcgguacaucgccgcgggccucaaguacgccgaccugagcuaccagaaggggaccggccuguacgggaucagccuccagcgcuaccagcagauccucaacucagagaagaucgagcugagcaucgagcaaaucgaguuacugcuggaaggccggcucaacgaguccaacuucgaguucugcuucagccuguacaagaacgacuucauccaguggaacgacgagaauaaccagacguuccaauaccgcuuccuggcccggaaccucucuagcccgaaccgcaucgaggucaagcccaucaacaaguccaaguacgacaagcaggccgaggggcugaagacccugaagaagggccucaaccgguucuacaagaucagcguggaugugcugggcuaccagcacuucauuaagaaggagaagcugaagcuaaccuucaaguga

SEQ ID NO: 7402 - RNA, 3330 nt, Artificial Sequence; identical to SEQ ID NO: 1602
  Cas9 variant

SEQ ID NO: 7403 - RNA, 3333 nt, Artificial Sequence
  Cas9 variant
auggccgaaggaaagaaacggauauggcgacuaggcgcugaucuaggcgcaaacucacuaggaugggccgccaucgaacugagcgcaccgguaaauggcaagccuaucgcgauacucgcagcaggaucaagaauauucagcgacggaagagaccccaaaagcggggcaucacucgccguagaccggagagacgcacgcgcaaugagacgacgacgcgaucguuuuaaacaaaggcaaaaagcacugaucaaauaccuaaucgccgacggacucuucccggccgacgaagcagcgaggaacgcaauggcagcaauugacccauacgcaguccgcgccagagcacuagaugaagcccuaaguuuaccagagcucggccgagcccucuuccaccuaaaccagcgacgaggauucaaaaguaacagaaaagcggauagaaaagcagacgacgacgcagguaagauagcaaucgggaucgacagaacacgagacgcaaucgcggaagacgaagcagacgcaggcgcagagccagggagcuggacguucggcaaauggcuacacgaacgccgccuaaaaggccaauccguccgcacgcgacuaagaccagaauccggcgaagacgcuaaaggagacggguacgacuuuuacccagaccgcgcacugauggaagaagaguucgacgccauaugggcggcccaggcaccacaccacccggacguacuuacuaacgacguccacgaccggcuccacgaaauaauauucuaucaaaggccgcucaaggccccacaagucggaaugugcagucugauaccaggagaccgccgacuaccaaaggcccauccccucuuccaacgacgaagauugcuagaggaacuuaacgcccugaugaucgugcgaccgggcgaaguagcacaacgccuaacacgagaagaaagagacauccuucuccuaaaauuaaaagacaaaaacaaagucagcuucgcaacuuuacgaaaggcccuaaaauuagaccccgaugcacgguucaacaaggaaucagaagacagaacggaccuaaaaggcgacgaaguagcagcaguaaugggcaguaaaacccgguucgggaaccucuggguacaccugagcaucgaagcgcagugggacguccucgcacguuuagacgcggucgaaagcgaugccgaagacgcagccuucugcgcauggcuaguagaaacguacgcccuaacaccugaacaagccagggccguggcaaaugcuccacuaccgcccggcuacggcagauucggugaaacagcaacgcgaaaauuaaucgaagcauuacgggacggaaagaaggacgaccgcgugcucguauacuccgaagcaguaacggaggccggccuagggcaccacagcgacaggaggacuggagagguauuugaagacgcaaaggguagaccacaacucccguacuacgggguagcacucgaaagacacauuaugccgggcaccggcgaccccuccgacccagaggagaugagaguuggacgacucacgaacccaacaguccacauaggacucaaccaacuacgacgaauacucaauguacuaauaagagcuuauggaccaccagccgaaaucgcaauagaacuagccagggagcucaaacuuaccgacgaggauaagaagagaaucaacagagagaacaacgacaaccggaucgcggccgagcggcgcagcgagaagcuacuagcaauaggacaagccgauagcggggccaacagagcacucuuaaaacuuugggaggaacugaacccagccaacguacuagacagacgcuguaucuacuccggacgccaaauaucgaucgacaugcuauuuagugcugcagucgaaguggaccacauacuacccuucgcggccacccuggacgacucaaauggcaacaaaaucgucugucucagagaagcaaacagagagaaaagaaaacgaucaccccacgaugccuggggacacagcgcaagaugggacgaaaucgcagcaagagcagcccaauuaccccggaacaaacgauggcgauucgaaccagacgccauggacaaguucagagacgagggagguuuccaggcgagacaucugguagauacacaauaccuagcccgccuaagccgagaguaccuggccacacuguaccccgagaagggggaaggcucagggcacaucugggucagccccggccgacucaccgaaaugguacguagaaaacucggccuaaacgaucuccuaccagaccacaacuucgggggaggagccgaccaagccaaaaaccgacuagaccacagacaccacgcuauagacgcaguugugguagccauuguagacaggggcaugcuaaacgcaaucgcccgagcaagcggacaagagggggcugaaggcagagaacgaauaauaaucccagaacccugggacggcuucagagacgcacuacgagaaacgguaaaccgcaucaccgugucucacagaacagaccacggcaccgccagcaaagcugggcuaccaaagggaaaagacgccaccgcaggacgacuccacaacgauacagcauacggcuucaccggugacaccgacgcaaaaggaaacuccaucgugguacgcagagucccacuuuccucauucaagaaauuggcagaccucgaccgcauacgcgacgccgaccuaaaagcagcccucuaccaacaccuaaacggccuggagggcaaggccuucgagaaagcacuggccgaguuccacaaacuagaauggcacaacuuuggcggaguaagacgcguaaggguaaccgagccacugaccguaauccccaucaaggacagaaacggccgcauauauaaagguuacaaaggcgacucgaacuaccgcuacgacgucugggaacucccagacggaaagugggugaccaacuggaaaaacgaagcaggcgaagcaaugagcagcguuauauccauguucgacgcucaccaaagcagcgaaccaccacgcccacacccagccgccagaaaaauacugagucugcaccagaacgaccugcuagcgauagaacgagaaggggaagacagaaaacuaaugcgaguggucaaauuuggacaaagugggcaaauaacgcuagcggaacaccagcaggcaggagaccugaaaaagcgcgacgccgucucaaacgacgaugauccauucaaauacuucgcaccaacauccggaggccugaaaaaggucaaagcgagacaggucagaauagaugaaaucggcagaguccuagaccccggauuccccgcccggacagcuagacgcaaaacacgcggcuga

SEQ ID NO: 7404 - RNA, 3333 nt, Artificial Sequence
  Cas9 variant
augacagcacgcacccauaaaauauggagacucggagcagaccucggagcuaauucgcucgguugggcagcaauagaacucucagcaccugucgacggaaaaccaaucgcaauacuacacgcaggaucaagaaucuucucagacggccgggacccaaaaagcggggcaagccucgccgucgacagaagagacgcacgcgcaaugcggagacgacgagacagauuacaacagcgacaaagggcacucauaaaguaucuuaucgcagacggacucuucccagcggacgaaaacgagcgcaaagccauggcaacaauagacccauacgcaguccgagccagagcgcucgaugaagcacuaacucugccugaagucggccgggcccucuuucaccucaaccaaagaagaggcuucaaaagcaaucguaaagccgacaggaaagcagacgaagaugcagggaaaaucgccauaggaaucgaccgaacaagagaugccauccggcaggccgaagaagaggcaggagcagaacccggaaguuggacuuauggaaaguggcucuacgaaagacgagccucagcaacagacgccaacgcaauaccauccguccguaccagacuucgaccagaaacggacgaacacgcuaaaggagacggcuacgacuuuuaucccggacgcgcgcucauggaggcagaguucgccgccauaugggaagcgcaggcagcccaccaccccgaugccuuaacaaaugaaguacacgaccgacuacacgaaauaaucuucuaccagcgcccacuaaaggcaccccaaaucggcguaugcacacucauaagaggggaccaaaggcuacccaaagcgcauccacuguuccagaaaagaagacugcucgaagaacugaacgcacugacgaucguaaggccaggcgagauggcgcaaagacuaacacgagaagaacgagacacccuuuuccugaaacucaaagacaaagccaaaguaucauucgugagccucagaaaaacccugaaacuggacccagacgcaagauucaacaaggagagcgaaaacagaagcgaccuaaaaggcgacgagguagcggcagcgaugggagcaaaaaccagauucggaaacagguggguacaccuaucaaucgaagaacaaugggacgugaucgccagacuagaagaagucgagagcgaugcagaagacgcagcaugccgagccuggcucgcggcaaccuucgaccugacaccagaacagauacgcgcagucaccaacgccccacuaccaccaggguacagccgcuucggaaaagucgcaacccagcgccucauagacgcacucagagacggcgagaaagacggacgcguccuaguauacagugaagcaguggcggcagccgggcuaggucaccacagcgaccuacgaacgggagagaucuucgaggacgcucaaggcaggccacaacugcccuacuacggcguagcguuagaaagacacaucaugccagguacaggcaauccggaccacagcgacgaaaugcgaauaggacgauugacgaacccaacaguccacaucggauuaaaccagcuccgacgaaucgugaauacacuaauaagagcuuacgggcccccggccgaaaucgccaucgaacuggcgagagaacuaaaacugacagacgacgacaagaaaagaauuaacaaagaaaacaacgaaaaccgacuagccgcagaaaaacgcagcgaaaaacuccucacgauaggacgcccggacaccggcgcaaaccgcgcacuccucaaacucugggaagaacuaaaccccgccaacgugcuugacagacggugcaucuacacuggaacucaaauaucaguggacauguuguucuccgcggcuguggaagucgaccacauccuaccauuuaccgcaacacucgacgauucaaauggcaacaaaaucguaugcaugcgcgaagcaaaccgaacaaaacguaaacaaagcccguacgaagcguggggacacacagacagaugggaggaaaucgcagcuagagccgcacaacuaccgcgcaacaaaagguggagguucgagcccgacgcaauggaaaaauucaaagacgaaucgggauuccaagcccgccaccucguggacacccaauaccuagcccgacugagucgagaauacuuagagacgcuauaccccggauccggagagggcuccagccacaucugggucagcccuggacgcuuaacagaaauggucagacggaaacucggacugaacgaccuucuccccgaccacaacuucggaggcggcgccgaucaggcaaagaacagacuagaccacaggcaccacgccaucgaugcgguagucguggcaauaguagacaggaguaugcucacagaaaucagccgcgucagcggguuggaaggcgcagaaggcagagaaagaauuauaauaccgccaccaugggaugaguuccgcaacgaccuccgaacagcagucaacgccauuacaguaucacaccgaacagaccacgggaccaucuccaaagcaggacuacccaaaggcaaagaugcaaccgccggaagacuucacaacgacacagcauauggcuucacaggcgaaaccgacgcaaaaggaaauucgaucgucguacgacgcgucccgcuagccucauucaagaagcuggcagaccuagaccggauucgagacacagaccucaaagcagcccuauaucaacaccuagaaggccucgaaggcaaggccuucgaaaaagccguaauggacuuccccaacuuagaauggcacccauucgguaacgucagacgaguccgcguuacggaagugcucuccgugaucccgauaucagaccagaacggacgcaucuacaagggauacaaaggcgacagcaacuaccgguacgacguaugggaacuacccggcggaaaaugggaagcagaaguagucagcaccuucgacgcccaccagcccgacuggguaucgaaaaucagaucacgcucccccaccgcacgcaaaguacuaagucuacaacaaaacgaccuaaucgcaguagaacgcgcacacgaaacacgcgaacuaaugcgcguaguaaaauuccgccagaacggcgaaaucacauucgcacccccacaagaagcugggucucugaaaaggcgggacgccacgccaaacgaagacgacccauuuaaguacuucgcuguagccgccagcucgcugcaaaaagcgaaagcacgacaggugcggaucgacgagcuaggccgcgucuuggaccccggcuuccccgcacgcacagcccgacgcaaaacccgaaaaagcacauga

SEQ ID NO: 7405 - RNA, 3333 nt, Artificial Sequence
  Cas9 variant
augcgcauacugggguucgacaucgggaucaccagcaucggcugggcauacguagagggagaggagcucaaggacugcggcgugcggaucuucaccaaggccgagaacccccagaacggggauucccucgcggccccgcgucgggaggcgagaggcgugaggcgccgacuggcccgccggaaggugcgccucaacgucauaaagcggcuccugugcaaagaguuuggccucaacuugagcgacuacuuugccaacgacggugagcugcccaaggcguacgaaacgaccaaggacaccaagucccccuaugaguuacgcucgcuggcccuggagcagaagcucgaacccaaggagcuagcccgggucauccugcacaucgccaagcaccgcgguuacgggaacaagcacgcgaagcgggaccucgaggccgaagagaaggccaagaaggccgcggagaaggcgccacaggagaaggaguccaccacgacgaacggggauucgaaaaaggagcaggagaaggugcugaaggcccuguaccagaacgagacccuccucaagaaauaccagaccaacuaucagacgaacaauaaaacuaacgacgagacaaacaacaaaaccauuuucuuagucgggaaguaccuauacaaggaguuccaggacaagggccagcggaucaggaacacuaccaauaacuaccagcacacgaugcgccaggaauggcugaaggacgagcuggaguucaucuucaaaaagcagaaggacuuuggcgcuaccuucuccgaaaacuuugagucccaaaucuuggagacggccuuuuaccagcgggaccuaaagagcuucgaagacaaaguggggaagugcguguucuaugagaacgagaaccgcgcacccaaagacagccuuucugcgauggaguucgucgcucucaccagaaucaucaacacucugaaaaaccuggagaagaaauccaaaaaccuaggcaucggggagacuuacggcaaggacaagauccaggagauccugaagaucgugcuggacaagggcgagaugagcuacaaggagcuccgaaagauccugaagcucaacgaguccauucucuucgccaaggacucaaagcuggacuacacgaaagggaugcaggaggccgagaaggccaaguucaucgagcugaagaaccucaaggcguucaagaaggccaugggcggggauuucagcaaauucccccgcgaggagcuggauaagaucgccaccgacaucguuuuaaucaaguccaaggagaaccucgcuaaaaagcugcagaacuacagcgcgcuguccaaggagcaggucgaggcgcucagcaaucugaacuucgccaagcacaucgaccugucccucaaggcccuugacaagauccugcccuucaugcgggagggccuguccuacgacgaaguugugaaaaagguagggcuccaggagcaccgcaaguacaaacagaagggcgaguuccugaucccgcugaaggaauacgaacccuaucucgccaacccagugguggcgcgggcccuaagcgaguaccgcaagguccugaacgcccuacuccggaaguauggaaacgugcacaaaauccaccuggaguucacccgcgaagccgggaagaacuacgacgagcgaaagaaaaucgaaaaggagcagcgcgagcacuucgaggccaaccagaaagcuaucaagcagcgggagaucuuaggccugcccauaaacggggcaaacauccuaaaaaugaagcucuggaucgagcagggcgaaugcugcguguacuccggcgagaaaaucaccucuaagcauuucuucgacuccaaugcgcuccaggucgaccacauuuaccccuacagccgcuccuucgacgacagcuacaugaacaaggugcuuguguucgccaaggagaaccaaaacaaguuaaauaagacucccuucgaggccuucggcuccgacaaggagaagugggaccggauccugagccugagugcgaagcucccuaaacagaagcagcgccggaucagcaauaaggacuucaaggacaaggagcugggcuucauugcccgcaacaucaacgacaccgguuacaucgcgcgccuggccucccaguggacgaacaacugccucaaguucgaagaccuucgcgagaacgaggucaccaucgccggcgagaaggggagcaagaaccaccucgaagugauaucgggucagcucacgagcauguuacggcacuauugggggcugggagauaaggaccgcaacaaccaucuccaccacgcgguugacgccgugaucaucgccuacaccaacgcgaaaaccaucaaggcguucgccgacuucaaaaagaaccaggagcagaaccgagccaaauucuacgccaagcagaucuccgagcaggaguacaagagacagcgcaaccccuucgagccgugcgccaacuuccggcaacggguggaggagaaaaucaacaagauauucgucuccaagccgcccaggaagcgcgcgcggggcgcccugcacaaggaaaccuuugggaguaucugccuagacggcaacaacaacuggguggcaagguucaagauuaagagcaaaaaggagcaggaggacaucacaaaggagaaagccacuaaggcgaaguacaaggaugaguucaagggggaggagaacauucggaaggcgcucaagcuggguaagauccgccggaucaacaacacacagaaagacaucgccaucggcgacaaaauagugaagaaugaaacgaugguccgcguugacaucuuuaaggacaagaagggcaaauucuacgccgugcccauuuacacgauggacuucgcucuggggauccucccgaacaaggccgucgcgaccggggaggaugaggacggcgugaucaaggacuggauugagauggacaagacaaaguacgaguucugcuuuagccuguucaaagacgaccugaucaagguacggaagaagaaaaugaaggaagccgagcucugcuacuuuguuggauuugacaccgacggcucccgaaucaucguugccaagcacaacaacgacuaucagaccaugacggagaacgaguguaagcuguucacccugaaagagaagaagaagaagcagaagacccucaacgacgaggaggacaaccaggagcggaucgaaaccgaguacaagauaaucggcggacgcacgggaauacagaaccuggagacguuugagaagcaccaggugagcccucucggagagguucagaaggcggaguucgaagaccggcaggagauuaagcugaaguccagccccaagggaaaggacuga

SEQ ID NO: 7406 - RNA, 3333 nt, Artificial Sequence
  Cas9 variant
augucggaaaaguaccgccucggccucgacguuggcacaaacucacuugggugggcugucauaggacucaaagaagacguccccucaagcguccuggcgacuggcguacgcaucuucagugagggaagggaugcaaaaacaaaguccacacucaaggccagcagaacggagaaacgcagcgcccggcgaagacgcgacagauuccuccaaagacaaaccuuccuuaucuccgaaaugguaaaaagcggccucuuuccaaaagacauagucgaacagaaaaaccucgaauugcuggaccccuacgaaauucgguucaaggcuuugaccgaacaagucccacuccaccaccuggggcgagcacucuuccacaucaaccaaagacgcggcuuuaaauccucccgaaaagacaagagugaggaaacaaccucgggagucguaagcaaaaguguccgcgcucucuacgaagaaaugcaacucauaaacccagcccccgugaucgacgacccaaaagcccuuaguaaagaggagcgacgagagauacggguccaggaggcauccucaagagaagaggccuuagugacccuagccgagcaaaaaggaguaacguucggcgcuuuccuauaccgacggcuccagucaggcaaaagcguccgcgcccgcaaggacgcagauucacaacuguaugacguguacccgaccagagagcuacugaaggacgaauacagcaagcucaugcaacaccaagcacaauauuacccaaacgucaucaacgaagcccucauaagccgccuacaugacgucauauucuuccaacggaagcuaaaagaacaagagcggggcuucugcacguacuaccccagcgagaggaggacuuucaggugcaugccaucauuccaacaauaccgcauggugcaagaguuaaacgcccuagaauggguagacgcagccggcaaacacugccuacgagacuaccccgaaagcagagaccugauacuaagcgagcuagaaaacauuagcacaaaagccggagaguucacauucgggaacaugaagaaaauccugaagaaaaugggggucaucgacggggaagucuccuuuaauuucgaaggccccaaacgcaaaggguuccagggaaacguaaccuccagagaaaugcgccacgaagacuguuucggcacccgcugggacgaacuaucacucgacgaaaaagacgacauaaucgacaaaaucaacgacgaccaccuugacgacgaggacauggagcgcuaccucaucgacacauacggccugagcuccuucagcgucgguaacgcuaucaacgcccgauuacuagaagguaccgccaacgucagccgcaaagccgcccgcacgcuuuacgaaaccaugcugucagccaacugccuacaaagcgaugcgguaauagccguuucagaacaagacgacacguucgucaauccauacucacgcacgggacgcggugaacuccucagcgagcucccauacuacggcgaggcauuccaagacgggagacacaucaucccaggaaaaagagagcccaaagucucacacgaccagcugaaauucuacggaggcgucucuaacccaacaguccacaucgcgcucaaccaaauccgacuggucguuaaugagauaaucaaacgcuacggccucccaagcuccauuagcauagaacuagcaagaaaccuacccgagggacaagacggcaggcgaaaaaucgagaaaaugcaaagugaaaaccagaaaaacaacgaacgcuacgaccaaauucuaacagaaaacgggcaaagcccaaacagagauaacagacuaagacuagcgcugugggaagaacuaggcgaaggaccaacggaccgacuaugugucuucacaggcaagcuaaucgagcuggccgacuuauucaacggcucagucgagauagagcaccucauaccauucucagucagucuagacgauuccaaggccaauaagacgguuuguuggaaagaggccaaccgcuucaaaggaaacaaaacccccuaugaggcauucgcaaacaauagcggagacuacucgugggaagaaauaauggaaagggucagagcgcugccaaacagcaagcaauggcgauuccaagaggacgcacucaaaaucuggaacagugaccacagcgacuucagcggacgacaucuuaacgacacacgcuacauaucccgccuagcacgagaauacuuagagaacaucugcccguucaacaaaaucgacgucgucaccggccgacuaacagcacuucuuagaggccacuggggccuaaacaacauccugagaggacacaacgaacccgaaaccgccaccccaaagaaaaugcgggacgaccaccgacaccacgcaaucgacgcggugguaauugcgaugacaucccuaacaauacugcaaaaagugaguagcgcggcagggaaagcagaagaauuagacgucggcaaacucuucgcuaaagacgaaagcggcagaucagugauugacccaugggacggcuuuagagacgagguagccgagaaaguccgaaacauaaucgucucccacaaaaccaaacgaaaaaccauagguaacuccggaaaaagcacggaccgagcccuccacaacgaaacagccuacggacucauagacggccccgacgaaaaagggcucuacagcgugguaaccaccaaaccgauuucauacuucgacaaccgggacaaaaucgagaaaauacgugacgaaaagcuaagagacgauuuccugacagcaugggacggcgaaggggacaacaaagccucccaacucgcaguccucgacaaagcaucuggacucaacgucaagaaaugccgauauguggagcggaaaaaggucauccccaucaacggacccgacggacaaccauauaaggcguacgauggcaauuccaacuggggcauggaaauauaugaguucccaaacggccaccccaaagaaaagaaauggaauggcgucgugauaucaacguacgacgcgaacaaaucggaauuuaaacccggggaaacauucagaccccaccccgccgcaaaacucgugaugagacuacacauaaacgacauaguggaaguacagaaugacggagaacccauucucuacagaguccaacucaucucggccgggacacugacagucucgccucugcacgaagcaaacguggacucacggaaccgagauaagcaugacgaguucaaguacaaaagccuaagcgucaccccaaugcagaaaaugggagcaaagaaagucaacauaucaccaaccggacugaagaacuacagccgcuga

SEQ ID NO: 7407 - RNA, 3345 nt, Artificial Sequence; identical to SEQ ID NO: 1607
  Cas9 variant

SEQ ID NO: 7408 - RNA, 3345 nt, Artificial Sequence; identical to SEQ ID NO: 1608
  Cas9 variant

SEQ ID NO: 7409 - RNA, 3348 nt, Artificial Sequence
  Cas9 variant
augagcgcaaccuacaccaucggccuggacauaggcaucgcgagcguuggcuggugcgcguucggcgaaacacacauacucgaccuuggcguucgcgcguucgacaaagccgaaacagccaaagagggcgaaagccugaaccuugcacgcaggaacgcaagacucaugcgcaggcgccucuuccgucgaacguggcgccucaagaaacuagcacggcaacucaaaagugaaggccuuaucgcggacacgaaacucuucaagccggaauuacccuucuccaaaagccuauggcagcucagagucgacggccuugaccgccgacuuaacgacgaagaaugggcccguguaaucuaccaccuaugcaagcaccggggauuccacuggauuucacgagcagaagcaaaacaagcagagggcgacuccaagucggaggguggcaaagugaaacaaggacuggcgggaacggccaagcucauggacgagaaaggcuaccggagcgcugccgaaauggugcucgccgaguucccgcaggcgcaacgaaacaaacagggcgaauaccaaaaagcccuauccagggaacugcucgccaaagaacucgcucuccuguucgcacagcagagagaauacggcaaucuacacacgccaggagcgcuagaaaccgcaauacucgggaacggcgacaagaaaucggggcuguucuggcaacaaaaaccagcacuagcgggaacagaccucuuaaaaaugcugggcaccuguaccuucgaaaaaggcgaauaccgcgcccccaaagccucuuucacggcagaaagacaugucugguuaacccggcugaacaaccuaagaauagucacggacggaguaacgaggcagcucacggaacaggagcgacaacuaugccuaccccuaccauauagacaagcaggagaucucaccuacaaacaacugggcagcgcgcuagcgaaagcuggacuacuagaagcggguggauucaaguucaccggacucgcauauccaacggaagcacaaaaggccgaaggcaaggcaaaggaccccgaaagugcaacacuuguaaaaauacccgccuggcaugaacucagacagacacucacaaaaggaggacuaaacgacgaaugggaaaaacuugcaggcgacgcccuauguggacaacccgaaaucuucgacaaaaucgcgugggugcuaucaguguacaaagaugacgacgaaguccgugcggaacuagccaaacuagcgcuaccgaauccccaagcacugaccgaagcccuucugaacauacgauucgacaaauuccacagccucucgcuaaaagcccuucgagccaucgucccacacauggaacagggccucagguacgacgaggcuugcguccaggcgggcuaccaucacagccaacuccucaaaguaggcgaaggcgaacacaaguaccugccgcccuuauacgacggucgggacggcgaugggagaaugauauucgccgaagacgccgacauucccagaaaccccgucguacugcgaagucugaaccaggcacguaaaguagugaacgccauaauacggcgauacgggagccccuccgccguccacaucgaaauggcgcgcgaccuaucaagacccuucgacgaacggaacaagauaaagaaagaccaagacgaauaccaagcgcgcaaccaacgcgaccgagaacaauucucagagcuauucggucaucccccaaagggucuagaguucgaaaaguggcgacuauaccgcgaacaaaacggccagugugcauauucccaacgaccucuaacggcguccggcaacgucgcagaaaucuuccucgacggcucaaccgaaauagaccacgcccucccguacagcaggaguuucgaugacuccaaaaacaacaaaguacucguacuaacaagagagaaccgagacaaaggcaacagaaccccauaugaauaccugggaggcgcagaaaacucagaguccuggcaaagguucgugagcuucgucgaaagcaauaaggcauaccgucuggccaaacgaacacgccuacuccgaaaagacuuuggggcgaaagaaagcgaagaguuccgagagcgcaaccuaaaugacacucgauacgucugcagauucuucaagaacuacguggagcagcaccuaaaacuggcagaaggcagcgaaacaaaaagaugcguggucgucagcggacaacucacaaacuuccugcgagcacgcuggggccuucuaaaaguaagauccgacagcgacagacaccacgcacuagacgcggcaguaguagccgcaugcagccacagcaugguccaacgacucagcaacuacagcagaacccgcgaacuagaacaaguaagagacggauucguagacauagaaacaggagaaauaguuaacccagcgaugcaucaacaacuucgggaacacuuccccgacccauggcccuacuucagacacgaacucgaggcccggcucaaaauagacagccccgaauuacuacgcgaggaaauggccagacuaggaagcuacuccgaggaagaacuaaaaguccucaaaccccuauucguaagcagagcgccccaacgacgaaauggaggggcagcccacaaagacaccaucuacggacaaccggaaaaacuaaagaaaaacggcucagugacacaaaaagucgcccucacaagucucacucuaaaggauauagaucuacucgccgacccacauagaaacgccaaacucuacggagcuauacgcgaaagacuggaggcacacggcggcaagggagauaaggccuucccggccacgaacccacuccgaaaacccgacaaagaggguaacccaacuggaccgauaguaagaacaguaacaaaaguaauagacaaacugaguggcaucccagugagaggcggcaucgccaaaaacgacacaaugcuccgaguugauguauucacgaaagggggaaaauuccaccuaguaccgguuuacguacaccaccgggucacuggauugccaaacagagcaaucauagcauucaaagacgaggaugaguggacgcuaauagaugacuccuucgacuggugcuucagccuauacccaaacgaccuacuccggauaaagcucaaaaaggaaucccacagcggcuacuacuccuccugcaaccgaagcacaggcgcagucaaccuaugggcccacgaccgcaacguaaacguuggcaaagacggcuuuauagaaagcaucgggguaaaaauggccguaaguauagaaaaacuacacguagacacacuuggcaauauauacccagcaccaccagaaaaacgccgcggacuggccuga

SEQ ID NO: 7410 - RNA, 3351 nt, Artificial Sequence
  Cas9 variant
augucccaaaaccaaaaccccaacacgcagagccaccucaacccaacaacacaaucgucgacccaaucaaacccacaacccacgacacaggaaucacuuaaaauacuaggcuucgacaucggagucgccucgaucggcugggcguucguagaaggaggggagcuaaaggacugcggcguccgaaucuucaccaaggccgaaaacccaaaagaugggagcagccucgcacucccaaggagagaagcacgggguguaaggcgacgacuggcccgcaggaaaggacgccucaacgcacucaaggugcucaucugcaaggaguucggccuuaacaggagugacuaccuagccacggcaggcgaacuccccaaggcauacgcaacaucgaaagaaacuaaaucccccuaccaacuccgcgcggagagccuugaaagaaaacucucggcugacgaauuugcccgcgucauccuucacauagccaagcaccgaggguacggaaacaaacacgcgaaagaaagcucggacgacgacuccggaaaggucaaaaaggcgaucucggaaaaucagaagguaaugagugaaaagggcuacacaaccgcuggccaguaccuguacggagaguucuaccaaaaagcgcgaaacuucagcgaagccgaacccaagagccccaaaaacgcgcgcgguacccaggaguucaagaacguccgaaacaagucagaaaauuacgcccgaugccuagcccagagcgaguuacaaaaagaacucgagaucauuuucgcaaaacaacgcgaguucggauuccaauucagcgacaagaaacacaaaacaaucaacgccaauggcaaacucaaagaacucgacuucgccgacgcaguccuugagaucgcauuccuacaacgaccacucaagagcuucgccgacaaaguaggcaaaugcaccuucuacgaagacaagccgcgcgcucccaaagacucauuaagcgccauagaguucgucgcacuuacccgcauaaucaacacccuagccaacaucaccaaacgauccggcgaagucuacagcgcagacaaagugcgcgaaauccucagcauuguauuagacaagggagaaauaacauacaaaaauuugagaaaagucauagcacucgaugaaagacuccaguuccccaaagacucaaaacuggauuacgccaaagaagaugcggaaaaggcaaaagccaucgaguucucaaaacugaaggccuucaggaaagcccucggcggcagcuucgaaggauucauacgagcagaacuagacucaaucgccacggacaucgcauuaauaaagaguaaggacgaacuaaaggcaaaacucgccaacuaccagagcuuaaacgacgaacagcgcgaaaaacuaucugaacucucguucgacaaauucaucgaccuguccuucaaagcacuagaagccauccuuccgcucaugcgcggcgacaaagacgacaaaaucuauagguacgacgaagcauggcgcgaagcaggccucgucgaagucgcaaagaaaacccaaaaaggcgacucccugccaccccuaaucgaauaugaaaaggaccucgcaaaccccgucguagcccgggcacucgcagaauaccgcaaaguccucaacgcgcucuuaaagaaacacgggaagguacacaagauacaucucgaguucacacggcaagccggagucagcagcaaagaacgaggggaaauuaucgccgaacagaacaaacgucucaaagcaaacgaagaagccagaaagcgcugugaagaauacggacuaaucccgagcgggaaaaacauacugaaacuaaagcuauggcaggaacagggagaguucugcguguauucugguaaaaagaucacccaaucagaccuccgagacgaaagcacacuacaaaucgaccauaucuacccauauagccgcagcuacgacgacucccaaaacaacaaaguccuuguguuuacggacgccaaucagaacaaacuaaaucagaccccauaugaggccuucggaaaagacaucagcaaauggaaucaaauacucggacgcaucgaaaaacugccaaaagcaaagaaaaaccgaauuacaaacaagaacuucgcaaacaaagaggcaggguucaucgcacgcaacauagucgacaccagcuacauagcacgacugagcgccagcuacaccgacgccuucaucgaguucuguccacuagcugaaaaugaagauaccacccuaggccgaggagaaaaggguagcaagaaacauauaucaguaguaaaugggucauuaacagccacaaugcgacacuauuggggccuaaauacacuacuggacggcgaaaacagcgaaagcaaagaccgaucaaaccaucugcaccacgcacucgaugccaucauuaucgccuacgucaacgacagcgucauuaaagcauucuccgacuucaaaaagacacaagaacaaaauaaagcccgacuuauagccaaagaaaucgaaagcgcagaguacaaaauaucccggagauuuuucucaccgucaggauuugagaacaacgaagcguuccgacaagcaaucaagcgaaaaauccucggacagucgcucgaaucaagagaaaaugacaugaccauaaacagcgaggcauugggagaaaaagucggcggcaucuucgucuccaaaccaccaagaaaaagagcacgaggagcccuacacaaggaaacauucagcuccaucgacgacaaggaccugcuaaagacauacggaggaaaagagggcguaaaccgcgccaucaaacuugggaaaguaagacaaaucggcagcaaaauagccgacaauggaacaaugguccgaguggacauauuuagacacaagguauccggaaaauucuacgggguccccauauauaccauggacuucgcccucgggauccucccaaacaaagccgucguaggaggcaaagauaaauccggcguaauaaaggacuggcuccccauggacuccaacuacgaauuuugcuucagccucuucaaagacgaucuaauacucguccagaaaaaggagaugagcaaagcagagcucugcuacuucgcgggauucgacaccucagggggacaaaucaagguagagaaacacgacaaccacuuugccacccucaccgacaaccaacgacuccuguucaacauagcaaccccaaaagaaguggccggaaagucaaucgggauccaaaaucuaaagguauucgaaaaguggcagguaucaccacucggagaaguaagcaaagcggaguucaaagaacgugaacccaucgcacucaaaucaacgccaaaacgcuucuugcaaggcuga

SEQ ID NO: 7411 - RNA, 3354 nt, Artificial Sequence
  Cas9 variant
augaagcacaucuugggccucgaccuggggagcaacuccaucggaugggccuucgugcagcaggacuucgagaacaagcaggggaagaucaucgccaccggcagccgcaucauccccauggaccaggggauccugggcgacuucgaacggggcaacaccguuucccagaccgcggagcgcaccaccuaucggagcaugcgccggcuccgcgagcggcaccuccugcgccgggagcgccuccaucgggugcugcaccuccucggguuccugccgccccacuacgacgcccagauagacuucaccaagcgcuacggcaaguuuaucgacaacgccgagcccaagaucgccuacaacaaugggaacuucaucuucaugaacuccuucaacgagaugguggaggacuucaagaagcaccagccccagcuguucuacaagaaguccaacggcgaggagagccggaucccguacgacuggaccaucuacuaccuccgcaagaaagcccugagccagaagaucacucagcaggagcuggcguggcucauccugcacuucaaccagaagcggggguacuaccaacugcgcggcgaggaggagaccgagaaccccaacaaggaggucgccuuccacucccucaaggugguggacgucgaggccgaggcccccaacaagaagggcgagaucugguacaccauccggcuggaaaacggguggaucuaccgccggacgagcaagaaccccuuagacgacuggaagggcaagacccgcgacuucaucgugaccaccgaccucaacgacgacgggacgaucaagcuggacaaggagggcaaggagaagcgguccuuccgcgcgccugacgagaaugacuggaaccugcucaagaagaagaccgagcacgacaucgauuucagcggcaagcccgugggaaccuacaucuacgaccaccuccugcagaaccccaaccagaagaucaagggcaagcugguccgcaccaucgagcggaaguacuacaaggacgagcugaaggccauccuggccaagcagaucgccuugcagcccgagcuguucacggagacccugcucgccgacugcauccgcgagcuguaccggaagaacgagacccagcagcagaaccugcucuccaaggacuuccugcaccuguucguggaggacaucaucuucuaccagcgcccgcucugcagcaagaaauccaccaucgcgaacugcacgcuggagaagcggagcuacaucgacaaggagaccaacgagcgcaaggacgcccccaucaaggucugcgccaaguccaaccccuacuaccaggaguuccggguccugcaguggcuccagaaccugcgcaucuacgagaucgagaccgaccgggaggugacagccgaguucaucgagacgccccaggauuacgaggcccuguucaacuuccucaugagccagaaggagaucgacaacgaggggcugcugaaguacuuccucuucgcgaagaacccgcagaucaaggacaaagcggccaaguccgagcugaagaaguggcugaccaccuaccgguggaacuacguguacgacgccgcugacaacagcagcaagaaguaccccaugaaugagaccggcuacgagcugcagcgguaccuucagaaggucgaggggcugcccgcgaacuuccugacguucgacaucaccuaccagcuuuggcaccuccuguacuccgugaaggacaagguggaguucgagaaggcccugaaaaaguucgccaagaagaaacagcuggacaagaccagcuucgucgacuccuucaagaacuucaagccauacccgaacgaguacggcagcuucuccgagaaggccaucaagaagcugcucccccugaugcgcuucggcaaccacugggacuucaaccggaucgacgugagcacucagaagcgcaucgacgaccugaucaacgggguggcgaacgaggacauacgcacgaucauccgcgagaaggcggagaaguaccagcucaauuccgagaccugcuuccaggaccugccacuguggcucgcccaauacgucguauacaaccggcacgccgaggccaccgauaucgagaaguggaccagcguguccgaccuggaggcguaccuggaggacuucaagcagcacagccuccgcaaccccaucgucgagcaggucgugacggagacccugcggguggugcgcgacaucuggcagcaguacuccggcgggcaggccaacuucuucgacgagauacacaucgaacugggccgcgagcucaaaaagaccgccgaggagcggaagcagcugucugacaagaaccaggagaacgagaacacuaaccugcgcaucaagaagcuccuggccgagcuuaaggaggacgccuccauccagaacguccggccguacagccucguccaacaggagcugcugaagauuuacgaggaagggguguucuccagcaccgacgagaucgaggaggauauccagaaaauucgcaagaaggucgagcccacgccgcccgagauccagcgguacaaacuuuggcuggagcaaaaguacaagucccccuacaccggcgaggugaucagccugaccaagcuguucaccgaggaguacgagauagagcacaucaucccccagucccgcuacuacgacgacagccugagcaacaaggugaucugcgaguccgcggucaacaagcugaagacgaaccagcucggccuggaguucauccagaaccaccacggggagaaggugcggaucaccgcgaacaaggaggugaccaucuucaccgaggaacaguacaaggaguucgucaagaagcacuaugccaacaacagcgccaagcagcagaagcugcuccugaacgagauccccgagaagaugguggcccgccagcuuaacgacacgcgguacaucuccaagugcaucuccgagauccucuccaagaucgugcgcagcgacgagaaggacgagggcgucaacuccaagaauaucaucccgugcaccgggaagaucaccaccgcgcugaagcaggacuggggccugaacgacguguggaacgagcucauccugccccgguucgagcgcaugaaccagcugacgcagacccagcuguucaccagcuacaacgaccggcugcaaaagaaccuucccaccgugcccaucgaguacucccagggauuccagaagaagcgcaucgaccaccggcaccacgccauggacgcccucgucauugccugcgccacgcgcgagcacaucaacuacaugaacaaccagcacgcgcuggacaagagcaaggacaagaaggagaagcagcaguccagaaucgaccugcacccgcucuga

SEQ ID NO: 7412 - RNA, 3354 nt, Artificial Sequence
  Cas9 variant
augcaaacgaaaaaccuccuauacacccugggacucgacaucggaaucgcauccgucggcuggugcguccugggagaaaauagaaucaucgaccucggggugaggugcuucgacaaggccgagacaccggaccgaggcgagagccuaaacaagguccgccgagaugccaggcuuaugcggcgacgccuccgccgacgcgccuggcgucucacuaaacuugcccgccuccugaaacacgcaggacugaucgacuccaccagaauuguccgagaccggcaugacggugcaguaucgccguggcaacuccgagucgaaggacuagacaggaagcucgcgccagaagagugggcacgaguuauauaccacaucguaaaacaccgcggauuccacuggaucagucgggccgaagaacguaaagcagaauccgauaaaggagaagguggcaaagucaagcaaggguugucagccacaaaacaacugaugguggagaaaaauuaccgaagugcagcagaaaugguacucaccgaguuccccggcgcacagcgcaauaaaagaggggaauacacgaaagcgcuuagcaggauucuauuggcagcagaacucacaacccuguucgaacgacaacaagaauuaggaaacccccacgccggaccagaccuacaaacaaagauccuuggcaacggcgaccgcaaaagcggccuacuauggaugcaaaagcccccacuaagcggcucggcacuacuaaaaauguuaggaaaaugcacuuucgagcgggaggaauauagagcgcccaaggcaucuuucacagcagaaagacacgucuggcuaacaaaacugaacaaucuucggguacucgucgauggaguaacuaggccauuaagugacccagaacgccgacuggcccuaucccuacccuaccagcaagcgagcgacuucaccuacaaacaacuccgagcggcacuuugcaaaaacgggcugcuaccggauucauuucaguuuagcggacuugcauacccgacaggggcccaacaacccgacggaaaagccaagaacccagaaaacgaucgcuuaguaaaacucccggccuggcaagaguuccggaaaacccuaagagacgccggacucgaaaccgaaugggagagcaucgccggaauggcagcaggcggacaaccggaccuccucgaucaaauaggguggguccugagcgucuuuaaagauggagacgaggugcucagagaacucagaaaaauaccauugcccgggggagagaaaaugguacaggccuuaucuggcguuucauucgacaccuuccacaaccucagccucaaggccuugcgaaagauaguaccucacauggaggccgggcuaagauacgacgaagcgugccuggccgcaggauaccaccauagugaccugaggaaagacacagacgagagaagucuguaccuaccaccgcuauacagcgggcgaacgaccgacggccgcaugguguucagagacgacauugauguaccuagaaaccccgugguauugcgcgcaaucaaccaagcgcgaacggucguaaauucggucguuagacgcuacggaaguccgagcucaaugcacaucgaaauggcaagagacuugagccgccccugggacgaaagaaacaaaguaaaaagagcgcaggaagaauaccgagacagaaacgaaaaacucaagaucgacuucgcggccgaauacgggaucgagcccaaaagccgagaguucgaaaaauuucuacucuaccgcgaacaaggggguaaaugcgcauacucgcuuaagccccuagaccuagacaggguccuccgcgaucuagguuacgcagaagucgaccacgccuuacccuacagccgguccuucgacgacagcaaaaauaacaaaguccugguucucgcagaagaaaaccgcaacaagggcaaccgaacccccuacgaauaccucgauggaaccuccgaaagcccgagguggagagaguucaaagcauucguggaaacaaacaaagccuacagauuggcgaaacgagcaaggcuucuccgaaaagacuucuccggaaaaggcucugaagaguuccgcgaccggaaccucaacgacacccgauacauaagccgcuucuucaagaacuauguagaaagguuccuaaaacuagccgaagaaucagaagaacgaaccugcguaguacucucggggcagcucaccgcauuccuucgagcacgaugggggcucgcgaaaguccgaggcgacagcgacagacaccaugccuuagacgccgcaguaaucgccgcaugcagccgaucaaugguaaaaagacuauccgauuacgcgcgcaggcacgaacuagaaaaagugcgaacaggcuucgucgacuucgagacaggcgagauagucgacgcaggaaaauaccgccaaauagagcgagacuucccaagccccuggccauacuucagagaugaacuacucacgcgacuaaacacggaugaccccgcggaauugcgagagcgaaugcaaucacuaggaaguuauccucccgaagcacucgagacccuacgcccaauguucguuagccgcgcaccccaacggagaaacggaggagcggcccacaaagacacuauauacagacagacagaacgacugaagaaaguaggcagcgucacgcaaaagguaccccuggcagccuugaaccuacgugaucuggagaaccuaguagacccccacagaaaugaaaaacucuacgccgcaauacgggccaggcucgaagcccacggcggcaaaggagaaaaggcauucccgccgaacaacccucuacguaagcccgaucgugacggaaauccaacaggcccaauuguacgcacuguaacgcuugugaucgacaaaaugagcggaauccccguaaggggaggagucgccaaaaaugauacaaugcuccgaguggacaucuucagaagcaagaaagauggaaaauuucaccuaguacccuuguacguacaccaugcaguagcaaagcagcucccaacgcgcgcagucauagcuuacaaggacgaaggagaauggaccccaaucaacaaccacgacuucgacuuccucuuugcccuauaccccaacgaccuaguccgcaucacccuuaaaaaggagcggcacuuuggauacuacgcgggauguaaccgggcaaccggcgccguaucaaucugggcacacgaccgcaaccagagaauaggcaaggacggauucauagacggaaucggggucaaaacggcgcuaucagucgaaaaauuccacguggacacacucggaaacgucuaccccgccccaccagaaacaagaagaggccucgccuga

SEQ ID NO: 7413 - RNA, 3357 nt, Artificial Sequence
  Cas9 variant
auggggaccagguacucuuucgacaucggaaccaacagcaucggcugggccgucuggagaacaggcagagacccgaaggggauuuucggcgaaaaggacgccccgcucgaacuacuaggcgcuggcguacgccuguucaaggauggccgaaaucccaaagacgggcaaucccuugccacaaugaggaggaucccgaggcaggcccgcaaaagaagggaccgauucguccuacggcgggaagcacucguagccgcacucaucgaggccggucuaaugccagcuucagagaaagagcggaaagcgcuggccgaccucgacccuuaccaacuacgagccgcaggacuugauaaagcccucgcaccgcacgaacuaggacgagcaauauuccaccuacaccagcgcaggggcuucaagaguaaccgcaaaacggaccgaaagucggacgaucgggacaaaggcaaaaucgcaacagccagugccgcgcuagcuaagaaauucgaagacgaaaacgcaagaacauuuggagaguuccuauggaggagacacagggaccccgauaugaaacgacaagcaguccucaaggcacacgaccccgcuaaaggcaagcccgaccuacgagcagcgaaacuuagacaacccacaaggauacgacuggaaggccagggagccacagcacuguacgaguucuacccaacacgcgaaaugcuaugccacgaguucgacgcacuaugggaggcccaggcucgacaccacccaaugcugcuaacaagagaagcaggagacaaaauccgaucgauacucuuccggcaaagagagcucaaaccaccccuaauaggccuaugcaccuucgaauacgcagccggagaaaaggaaagcagacuacccaaagcgcuaccaagcguacaagcaagagaaaucuacgaaaggcuuggacacauacgguuaagcacagggagcggcacagaccgcccacucaaaagcuccgaaagagacgaccucgcgaccgcacuccuacacugcggccucacgaagauaaaaguaucaaagacaaaaggacuggcauucaaaacagaguucagaaaagcacuccgauuggguggcgaagucagaauaaacuuugaagagaugggcgaagagggucuaguggaccucagaaccaacagacuacucguccaagacgaccacuacggaccacgauggcgcgcccuuagcugguccggaaaagacgccuucgugaagaaacuccuagaggcgacggacgacgacaagcuaguagcacgacuaaugacagaggauggacugucagcaguccaagcacgaaacgcagcgagcaucccacuacccgacggcuauagucgacucggacccaccgccaacgccgcgauccugcaagcacugauagacagcagagacgagaacggauuugucgugacuuacgacaaagcaguacggagagcaggggagagacucggcaaagacuggcaccacucagacgaaagagacggagaaauccuagacgcccuaccguacuacggaaaaguacuacaaagacacauccuccccgggaugauggaccccgcggaucgcaaagacgaagcaaaauuuuacggacgaaucaugaaucccaguguacacaucggauugaaccagcugcgaaggcuaguaaacgcccuaaucgagagguuuggaccgccagaccaaaucgucgucgaacuggcaagagaccuaaaaaugucugcaagggagaaagaacaagaacagagaagaaacagagacaaccgagaagccaacgaaaagcgaacgaaaaagcuaguggaacuaggucaagacaacaauggcgaaaaccgggcaagacucaaacuauacgacgaacaacaacgagcaggcaacggaguagcccacugccccuucacacuagacccaaucggcaucacucaacucuucagcccagaaaucgaaaucgaacacguacuacccaggaguagaacacuagacgacucugccgcaaacaagguauuaugcuuccgaacaauaaacagaauaaagcgaggaaaaaccccaugggaagcauuucacgcggauccgaaauggccagacaucgcagccaacgccgaaaaacuuccuccaaacaagagauggagauuccgagaggaugcuauggauguguucgaagcaagaacaagcgggaaaauggacaagacaaccuuggaacagauggggcuaacaacaggcuuccaagcucgccaccuaaacgaaacaaaacacaugagcagacuagcuaaggcguaccuaggaaaaauaugcgaccccgacgccguguacguaacaccaggcgcccucacaagucuguuacgggguaaauggggccugaacucaauccucagcgacgacaaccucaaggacagaacagaccaccggcaccacgcaaucgacgccaucacaauaggagcaaugacacgaucccuacuacucgaacugaacacccuagcagggaaggccgaacaaagcgacuaugacgacguggugggcaaaguacccuggccauuugacaacuuccgagacgcgguacgaagugucguagacagagucguugucaguaauaaacccgaacacggcaagcagggcgcacuccacgaggacacagcauacggaauaguaggagaugaagcggaggcagaggaaaucgggaacuuaguaaggcgcaaacuauuaguagaccucacacccggagagguagacagaauuagggacgccggccugcgcaaggcgaugcaagcagcggucgcgcccagccgugacgccaggggcaagguaucagacgcaaaaggguucgcagcagcacuagacacguucgccaaagcacaagguaugagaagaaucagagucggcaaggaagacaugagcgcaguaaccauccacgaccgccaaacggacaaagcguauaaagccgucgcaccgggcgaaaaccaccacguugacgucguccaaaugcgcgacggcgcauggaaaggauucgcuguaaccguauucgaagcgaaccaaaaggauuuuagaccacaaugggaaagagagaaacuaggaggaaagcuagucaugcgacuccacaaaggugacgcgguagagcuggagagcagcgggguaaggcucgugaaauucgugcaacaaauauggaugaaaagcaaccugguacuacuaaccgagcacaacgaaggaggggaccugcaaaaacgacaccaagaugcagacgacccauuccgcugggacuucgcaaacauagggaaacuaaaagaacgcggaugcguggcggucaaaguagacgagcucggaagagugacaaaacgaauaucaaauacguga

SEQ ID NO: 7414 - RNA, 3360 nt, Artificial Sequence
  Cas9 variant
augggcuacagaauaggucucgacguaggcaucacaucgaccggcuacgccguucuuaaaaccgauaaaaacggccugccguauaaaauauuaacuuuagacuccguaauuuacccgcgcgcggagaauccucagaccggagcaucacucgcagaaccucggcgaaucaaaaggggacuuagaagacgcacacgccgcacaaaauuccgcaaacaaagaacgcagcaacucuucauccacucaggccugcuaucaaaaccagagauagaacagauacuagccacgccucaagcaaaauacagcguguaugaauuaagagucgcaggacuagaccgccgccucaccaacuccgaacuguuccgcguacucuacuucuucaucggccaccgcggcuucaaauccaaucgaaaagcugaacugaaccccgaaaacgaagcagacaagaaacaaaugggccagcugcuaaacucaaucgaggaaauacgcaaagcaaucgcagaaaaaggcuaccgaacggucggcgagcuauaccucaaagauccuaaauacaacgaccacaaacguaacaaaggauacaucgacggguaccucagcacaccuaaccgccaaaugcuggucgacgaaauaaagcaaauacuggacaaacaacgagaauuaggaaacgagaagcucaccgacgaguucuacgccacguaccuacucggcgaugaaaaccgagcaggcaucuuccaggcccaacgagacuuugaugaaggcccgggcgcggggccauacgccggagaccaaaucaagaaaauggucggaaaagacaucuucgaacccacagaagaccgagcugcaaaagcaaccuacaccuuccaguacuucaaccuacuucagaaaaugaccucacucaacuaucaaaacacaacaggagauacuuggcacacccucaacggacucgaccgacaggccaucaucgaugccgucuuugcgaaggcugaaaaacccacgaaaaccuacaagcccaccgacuucggcgaacuccggaaacuccuuaaacucccggacgacgcaagguucaaccuagucaacuacggaagccuccaaacacaaaaagagauagaaacuguggagaagaaaaccagguucgucgacuuuaaagccuaccacgaccugguaaaaguccucccagaagagauguggcagagccggcaacuucuggaccacauaggcaccgcccuaacccucuacagcucagacaagcggcgccgcagauacuucgccgaagaacucaaccuccccgccgaguuaaucgaaaagcugcucccccugaauuucucaaaauucggucaccuauccauaaaaagcaugcaaaacauaauaccuuaccuagagaugggccaagucuacagcgaagcaacaacaaacacaggauacgauuuucgcaagaagcaaaucucaaaagacacaauacgggaggaaaucacuaauccuguaguccgacgagcagucaccaaaaccaucaaaaucgucgaacagauaauacgccgcuacgguaaacccgacggcaucaacauagaacuugcgcgcgagcugggccgcaacuucaaagaaagaggcgacauacaaaaacgccaagacaagaaccgccagacaaacgauaaaauagccgccgagcucaccgagcucgggaucccagucaacgggcaaaacaucauacgcuacaaacuccacaaagaacaaaauggugucgacccguacaccggggaccaaaucccauucgaacgugccuucagcgagggauaugaaguggaccacauaaucccauauucaauauccugggacgauagcuacacaaacaaaguucuaacaagcgccaaaugcaaccgagaaaaaggcaacagaauacccaugguauaccuagccaacaacgagcaacgccuaaacgcacugacaaacauagcggacaacauuaucagaaauucccgaaaacggcaaaagcuacucaaacaaaaacucucagacgaagaacugaaagacuggaagcaacgcaacauaaacgacacgcgcuucauaacacgaguccuauacaacuacuuccgacaagcaauugaguucaaucccgaacucgaaaagaaacaacgaguacucccccugaacggggaagucaccagcaaaaucaggagccgcuggggcuuccucaaaguacgagaggacggcgaccuccaccacgcaauagacgccaccgucaucgcggcaauaaccccaaaauucauccagcaggucacuaaauauucacaacaccaggaagugaaaaacaaccaggcccuauggcacgaugcagaaauuaaagaugccgaauacgcagccgaagcccaacggauggacgcggaccuauucaacaaaauauucaacggauucccccuacccuggcccgaguuccuagacgaacuacuggcacgcauauccgacaaccccgucgaaaugaugaaaucacgguccuggaacacauacaccccaaucgaaaucgcaaaacucaaacccguauucgucguacgccuagccaaccacaaaauauccggacccgcccaccucgacaccauccgaagcgccaaacuauucgacgaaaaaggcauaguucucaguagagucaguaucacaaaacucaaaaucaacaagaaaggacagguagccaccggcgacggcauauaugaccccgaaaacuccaacaacggcgacaaagucguguacuccgccauccgacaagcauuagaagcacauaacggaucaggagaacuggcauucccagacggauaccucgaauacgucgaccacggaacaaagaaacucgucagaaaaguucgcgucgcaaagaaagucucgcuaccuguccgacugaaaaacaaagccgccgcagacaacgggagcaugguccgcauagauguauucaacaccggcaagaaauucguauucgucccaaucuacauaaaagacaccgucgaacaaguacuaccaaacaaagcaauugcaagaggcaaaucccugugguaccaaauaaccgaaagcgaccaauucugcuucucguuguaccccggggacauggugcacauagaaagcaaaacaggaauuaaacccaaauacucgaacaaagaaaacaacaccucggucguaccgauuaaaaauuucuacggauacuucgauggugcggacauagcaacggccagcauccuggugcgcgcccacgacuccuccuauaccgcccguagcaucgggaucgccggccuucucaaauucgaaaaauaccagguggacuacuucggacgcuaccacaaaguacaugaaaagaaaaggcagcuauucguaaaacgcgacgaauga

SEQ ID NO: 7415 - RNA, 3360 nt, Artificial Sequence
  Cas9 variant
augaacgacaagaaaaaccuaggcccccuaacauucggguuugacauaggaaucgcaucagucggcugggccguccucucaccaacccgcauaguggacuuagggguccgcugcuucgacaaagccgagaccgcgaaagagggagaaagccucaaucuagcaagaaggucagcacgccugaugcggcgaaggcugcguagacgagccuggagacucauaaaguuagcgcgacuccuaaagcaugaaggacuaauagccgacacgaaaacuuucauccaaccaagcgccucacacgcgucccccuggcaacucagaaaggacggccuagaccgcgcacucucacccgaagaaugggcaagaguucucuaccaccucuguaaacacagaggauuccacugggugagccgcgccgaggcgagaaaagcggacggagacacaaaaggugaagggggaaaaguaaagcaaggccucgcgagcacgacaaaacucaugaacgacaaaagcuacagaacagccgcagaaaugguacuggcagaguuccccagcgcgcaacgaaacaaaagaggggaauacacaaaagcccucucacgagaacugcuagacaacgaacuaaaacaacuauucgaacgacaacgagaauacggcaacccacacgccgacaccaaucuggaagccaaaauccgaggcagcggcgaccacaagucagggcuauucugggaacaaaaaccagcacuaagcggaaacgacuugcuaaaaaugcuagggaagugcacauucgaaaagcaagaauaccgagccccgaaggcaucguuuacagcagaaagacacgucuggcuaacccggcuaaacaaccuaagaaucauaguugacggacgcacgcggccacuggccgacgccgaaagaacgauggcgcucucacuccccuacgaacaagucggggacuuuaccuauaaacaacuaagagcggcacugguaaaagccggacuaaugcccgacuccuucaaguuugcaagccuagcuuacccgucagaguuccaaaaagccgaagggaaagcaaaagaccccgaaagcgccgcccuaacaaaacuagcggccuggcaagagcuaagagcaacccuaaagaaagccgaccucgagagcgaguggcaacaaauaucaugcgcagcacuagagggacagccagaaacacucgacgaaaucgccggaguccucagcgucuucaaagacgacgacgaaguccucaacgaacuacaaaagcucggacuccccggaggggcaaaaacagaaaacgcacugcucgacaucagauucgacaaguuccacgcacugagcuuaaaggcacuacgaaagaucguaccguacauggaacgaggacuacgguacgacgaagccugcgaacgggcagaauaccaccacucccaacugcacaaaguaggcgaaggcaaccgcaaauaccuaccgccccuauacaagagcagagacaaagacggacgcaugguuuucaacgacgaacuaggagacauaccaagaaaccccgugguccuccgaagccucaaccaagcccgcaagguacuaaacgccuuaaucgcacgauacggaucaccaucaagcguacacauagagauggcccgcgagcucagcaagccauucgacgagaggaugaaggucggaaaagaacaggaagcguaccgggaaaggaaugaaaaagacaaacaaacuuucguggcggaguucggcauagugggcgccgcgaagggcggagaguuugagaaguggaagcuguacagagaacaacagggcaagugcgccuauaguauacaggggauagaccuaaaccgccuacucgaaccgggauauguugaaaucgaccaugcacuaccauauucacgcagcuucgaugauucaaagucaaacaaaguccuagugcuggccgcagaaaauaggaacaaaggaaacaggaccccauacgaguaccuagauggggaacacaacucagagcgcuggcgacaauucgucggauucguagagagcaacaaacuguaccgccaagcaaaaaggagcagacuacucaggaaagacuucggcaaggaacaagccgacgaauuuagagagcguaaccuaaacgacacccgcuacgucugucgauucuucaaaaaccagguggaacaauuccugaaacuagccgaaggcucggaaagcaaacgcugugucguccuaagcggacaacucacagcauuccugcgcgcacgcuggggauuaaucaaagugagagacgaauccgaccgacaccacgcacucgacgcgguagucguagccgccugcacccacggaaugguaaagcgcaugagcgacuacgcaagacggaaggagcucgaccaagucgcggaaggauucguagacguagaaacaggggaaaucaucaacgcggccauguuucaacaacuacacgaacacuuccccgacccauggccccacuuccgcgacgaaguucaaaugagacugaagaucgacgacccagcccaacugcgaagugaccuacucagacucggcaauuacgccgaagaagacgugcacgcagugagaccacuguuuguaucacgagccccacaacgaagaaacuccggagcagcccacaaagaaaccaucuacggccaaccagagagauugaaggcacaaggaggaguaaccgagaaaguagcacucacagcccucacgaugaaagaccuagaccgacuuauagacccacaccgcaaugaaaaacuauacgccgcgauccgcaagagacucgaagaguuuggcggaaaagcggacaaggcauucgccgcuagcaacccacuucacaaaccggacaaggaaggcaacccaacaggacccaucguacgcacaguaacccucgaaauagacaaacuaagcggagucccaguacgaggaggcaucgccaaaaaugacacaaugcuccgcgucgacguauucacgaaagcaggcaaguuccaccuaguaccaguauacguacaccacaaggugacaggccuccccaacagggcuaucguagcgagcaaggacgaagacgaauggacugcgauugacgacaguuuugaguuccuauucagccuguacccaaacgaccuagucaccaucacacagaaaggaaaggccccgguccgcggcuauuacgcaagcugucaccggggcacaggagcauucucccuaugggcgcacgaccgagcaagcucagucggcaaaggaggccagauagaagggauaggcauuaaaacagcacucgcuguccaaaaguacaauguggacguccuuggcacaacauacgccgccccgcuggaacaaagaaggggucuagccuga

SEQ ID NO: 7416 - RNA, 3363 nt, Artificial Sequence
  Cas9 variant
augcgcaaggugaccauugguuucgacaucggggucagcuccgugggauggagugugguagauaugaacaauggggccaucguggagaccggcgugcggcuguucucggcuaguuccgcggagaacaacgucgagagacggaacaaccgucagacgcggcgccucaaccggcgucggaagaaccgcuugaaagacgugaaguaccugcucgagaccaaccacuucaccuucgaccaggagcaggggaccaaccccuacgagcugcggguggccggccugcaccgcaagcucacgcggagcgagcuggcucgcgcccuguaccacuuggucaagcggcgcggcaucuccuacgaccugaccgacaucgaggaggaagagaucguaaccaccagcgcauacaagacggcgcuggggaagaaccagucccaacucgccgagaagaccccgggcgagauccaguucgcucggcuggagaacuacgggaagguccgcggcagcauugaaauaaacgagcaggacauccugcucaacaucuuccccaccucggccuaccugaacgaggcgaagcggauccuggccacccagcgcaaguuuuaccccgagaucacggaggccuucauagagaaguacugcaccauccucacgcggaaaagagaguacuacgucggucccggcaccgagaaaaaucgcacugacuacggaaucuaccgaaccaacggggagacccuagacaaccuguucgaaauacuaaucggcaaggacaaguucuacccgaacgaggaacgcgccgccgggaacagcuacaccgcgcaacuguucaacuucgugaacgaccuaaacaaccucaagauccagacgauugaggaccagaagcuaacccccaagcaaaaggaggagauuaucgagcaggucaagaccgccgagaagaaggucucccugauucagcucaucagcaagaucaccaagacgcccaaggaccagaucaccggcuaccggaccgacaagaacgggaaacccgaccugcacuccauggccguguuccgcaagguuagaaagcaguuccugaccauggagaucgacauccuccacuggccggacgagcugcugaacgaccucgggcgccugcugacgcucaacaccgaaaagggcgagauccggaagcaacugaccaaggacuucaugaagcgcuaccccauccugaacgagcagcucgucgaccagaucaucgagaaccggcacaucuucgcuguaagcgggaaccacaaauggcaccgcuucucccugcggacgaugaacgagcugcuucccgagaugcuagcgacgagcaaggaacagaugacccuacucuccgagcgcggcaugauuaagcagcauaagcgggacuacuugaagaugaacgagcuagacgcgcgccucaucagcgaggagaucuacaaccccguggucggcaagagcgugcgggaagccaucaagcuguucaacgaguuaaugaagaaguaccaggaggugcgcuacgucgugcuggagaugccgcgagacgacaacgaagagaaggccaagaaggagcuccaaaaguaccagaaggagaacgagaaugagaaggagaucgcccuguccgaguuccagcgcaagggcuucuucuccgacgcgcagcuggagcgggcgcucaucaaggaccgcaaguugaagacuaagauccgcuucuggcaccagcaagagggcaagugccuguacuccgggcagaucauuacccccgucgagcuccugacgaacagcuucuccuucgacaucgaccauauuaucccccagagcgugucuuucgacgauagcuuaaacaacaagguguuaugcaccaaggagaugaacgaucagaagggcaagcagacccccuacggguuucugcuuaacggcaacgggcagggcuucgaccgguuuaaggccauggucaacgccaaccgccucauguccaagggcaagaagaaaaaccugcuguucauggaggaccucaacaacaucgagacccguaagcgguucaucgcucgaaaccuuguggacacccgcuacgccagccggguugugcugaacgagauacaacaauaccuccgcgcgaaaaacaaagacacccagguggccgugguccgugggaaguucacggccacccugcgcaagcacuggaacaucaacaagucccgggagacccaccaccaccacgcccuggacgcuagcaucaucgccaucacgccgcuccucuccguguggaagaagaagcagacgcugaucccuaagaccuugagcgaggaaaagcuggaguucgaguacgacgacauaguggaggauacuaucuucgagaaggcgcuguaccagcuccccaaggagaacuucaaggaacagcugaacaauagucagcccaauaucaaauucucauaccaggucgacaagaagaugaaccgcaaggugagugacgccacaaucuacagcgugaagcaggcaaagcuguccagcgacaaacagagcgaagaguacgugcucgcgaagaucaaggacauuuacuccguugagggcuacaaaacauucgcuaagaucuaugagaaggauaagagcaaguuccugauggcccagaacgacccgaagaccuucgagaagcuggaggagaucauccagucguacccgagcacccgggagaucauagugggggagaaggucaagguuguggacgucucccccuucgagcucuaccguaaggaguacggcuacaucacgaaguacgccaagaaaaacaaugggcccaucauccggcagcugaaauacuacgaccacaaaaucggcaugcaccucgacaucaccaaccagaagaacaacggcaaggggaagaaagugauccuccagcaacucaagagcuggcgcaccgacguguacuacaaccacgagaagcaggaguacgaaaucaugggccugaaguacagcgaccugcgguucaagaaggaccaauaugggaucccgaaggagagauaccaggaggucaagcagauggagaagaucgcgccacagagcgaguuuuguuucucccuguaucggaacgaccgcaucaaggugcugaacaaggagaccgacgaagagguggagcuccuguucggcgcccggaacuacacaagcgccggcuacgucgaccugaaaccaaucgaccgcgucgaguucgggaagaaagaauggauccccguguaccaguacgccaccucugacggcaagugcaagaagaaguucgcuaagaagggguaugaaaucuacaaggucaacaccacgauccucggcgagaguuacuacaucaagaaggagcgcaugcuaccgaaaaauauccuggacuga

SEQ ID NO: 7417 - RNA, 3363 nt, Artificial Sequence
  Cas9 variant
augagcgaccuggugcucggccuggacaucgggaucggcuccgucggggugggcauccugaacaaggugaccggggagaucauccacaagaacagccgcauauuccccgccgcccaggcggagaacaaccuggugcggcgcaccaaccggcagggccgccggcugacgcgccggaagaagcaccgccgggugcgccugaaccgccucuucgaggagaucggccugaucaccgacuucaccaagaucuccaucaaccugaacccguaccagcuccgggugaaggggcugaccgacgagcugagcaacgaggaacuguucaucgcccugaaaaacauggucaagcaccggggcaucuccuaccuggacgacgccagcgacgacgggaacuccagcgugggcgacuacgcccagaucgugaaggagaacuccaagcagcucgagacgaagacgccagggcaaauccagcuggagcgcuaccagaccuacggccagcugcggggcgacuucaccgucgagaaggacgggaagaagcaccgccucaucaacguguuccccacgagcgccuaccgguccgaggcgcugcgcauccugcagacccagcaggaguucaacccccagaucaccgacgaguucaucaaccgguaccucgagauccuuaccggcaagcgcaaguacuaccacgggccgggcaacgagaagucccggacggacuacggccgcuaccgcaccagcggggagacccuggacaacaucuucggaauccucaucgggaagugcaccuucuaccccgacgaguuccgggccgccaaggccagcuacacggcgcaggaguucaaccugcugaacgaccucaacaaccugaccgugcccaccgaaaccaagaagcuguccaaggagcagaaaaaccagaucaucaacuacgucaagaacgaaaaggccaugggccccgccaagcuguucaaguacauagccaaauuguugagcugcgacguggccgauaucaagggguaccgcaucgacaaguccggcaaggcggagauccacacguucgaggccuaccggaagaugaagacccucgagacccuggacaucgagcagauggaccgcgagacccuggacaagcucgccuacgugcuaacgcugaacaccgagcgggagggcauccaggaggcccucgagcacgaguucgccgaugggagcuuuucccagaagcaggucgacgagcucgugcaguuccgcaaggcgaacagcagcaucuucggcaagggguggcacaacuucuccgugaagcugaugauggagcucaucccggagcuguacgagacaagcgaggagcagaugaccauccugacucggcucggcaagcagaagacgaccuccagcuccaacaagaccaaguacaucgacgagaagcugcugacagaggagaucuacaaccccgugguggccaagagcgugcgccaggccaucaagaucgucaacgccgccauuaaggaguacggggacuucgacaacaucgugaucgagauggcgcgggaaaccaacgaggacgacgagaagaaggccauccagaagauacagaaggccaacaaggacgagaaggacgccgccaugcucaaggcggccaaccaguacaacggcaaggccgagcugccccauuccguguuccacggccacaagcagcuggccaccaagauccgccuauggcaccagcagggggagcggugccucuacaccggcaagacgaucuccauacacgaccugaucaacaaccccaaccaguucgaggucgaccacauccugccgcucuccaucaccuuugaugacagccuggcgaacaaggugcuggucuacgcuaccgccaaccaggagaaggggcagcgcacccccuaccaggcgcucgacuccauggacgacgcguggagcuuccgggaacugaaggcguucgugcgcgaauccaagacccugagcaacaagaagaaggaguaccuacucacggaggaggacaucuccaaguucgacgugcggaagaaguucauagagcgcaaccuggucgacacccgcuacgccagccgcguggugcucaacgcccugcaggagcacuuccgggcccacaagaucgacaccaaagucagcgugguucgcggccaguucacuagccagcugcgcaggcacugggggaucgagaaaacgcgcgacaccuaccaccaccacgccgucgacgcgcucaucaucgccgccuccagccagcugaacuuauggaagaagcagaagaacacccucgugagcuacuccgaggaccagcugcuggacaucgagaccggcgagcucauaagcgacgacgaguacaaggaauccguguucaaggcccccuaccagcacuucgucgacacgcucaagagcaaggaguucgaggacuccauccuguucagcuaccagguggacuccaaguucaaccggaagaucagcgacgccaccaucuacgcgacccgccaggccaaggugggcaaggacaaggccgacgagaccuacguccucgggaagaucaaggacaucuacacgcaggacggcuacgacgccuucaugaagaucuacaagaaggacaagucgaaguuccugauguaccggcacgacccccagaccuucgagaaggugaucgagccgauccuggagaacuaccccaacaagcagaugaacgagaaggggaaggaggugcccugcaaccccuuccucaaguacaaggaggagcacggcuacauccgcaaguacagcaagaagggcaacgggcccgagaucaagucccugaaguacuaugacagcaagcugggcaaccacaucgauaucacccccaaggacuccaacaacaaggucguucuccagagccugaagcccuggcggacugacguguacuucaacaagaacacggggaaguacgagauccugggccucaaguacuccgacaugcaguucgagaaggggaccggcaaguacagcaucuccaaggagcaguacgagaacaucaagguccgcgagggcguugacgagaauagcgaguucaaguucacccuguauaagaacgaccugcuccuguugaaggacagcgagaacggggagcagauccuccugcgguucaccucccgcaaugacacgagcaagcacuacguggagcugaaaccguacaaccggcagaaguucgagggcucagaguaccucaucaagagccuggggacugucgugaagggcgggcgcugcaucaagggccugggcaaguccaacaucagcaucuacaaggugcggaccgacguccucgggaaccagcauaucaucaagaacgagggcgacaagcccaagcuggacuucuga

SEQ ID NO: 7418 - RNA, 3363 nt, Artificial Sequence
  Cas9 variant
augggccuggacaucgggguggccagcgucggcuucuccgugcucgacaucgacaaggggaaggugaucgagcugggcgcccgccuguucagcgcgacugucgccgccgggaaccaggaccggcgcgacaugcggggcgcccgccggcuccugaaccgcaacaagcagcggcgccaggacaccggcaaacuguucaagaaguucgggcucaucgacgacuucgacaagggcuccuucuacgacaacuucaaccagaaccugaaccccuacgagcugcgggugaaggggcucacggagcagcugaccaaggaggagcuggccgagagccucuaccagaucgugaagcaccgcggcaucuccuacgcgcugaaggacgccgacgucgacgagggcggaaccgacuacagcgugucccugaagaucaacagccaggagcucgccgagaagaccccggcccagauccagcugcagcggcugaacgacuacggcaaggugcgcgggcaagucgugaucggcgacgaccccgacaaccagaaggugcuccugaacgucuuccccacguccgcguacgagaaggaggccaagcagaucaucgccacccaacagcaguucuaccccgagagccugaccgacaaguucaccgaggaguacugccagauccucacgcggaagcgcgacuacuucguggggccgggcaacgagaagucccggaccgacuacggcaucuacaagaccgacgggcgcacccuggacaaccuguucgaggagcucaucggccacgacaagaucuaccccgaggagcuucgggccuccgccgcguccuacacggcccagcuguucaacgugcucaacgaccugaacaaccugcgcauccucaacuacgaggaugggaagcugaccaaggaggacaaagagaagaucaucgccgagaucaagaacaacaccaccacgaucaacaugcugaacgucaucaagaagguggccggcugcucuaaggacgacauuaagggguuccgggugaacgaaaaggacaagcccgagaucuccagcaugccggucuaccgcaagauccacaaggaccuccuaaaggccggcguggacaucuccgacuggccgguggaguucaucgacgaacugagcuucauccucacccugaacaccgagaacggcgagauccggaagcagcucaacaaccgccucgcgcccaaguucgacuuccugaacgccgaccugauccaacucaucaucgacaacaaggacagcuucgagaucaagaccaacaacaaguggcaccgcuucagcgucaagacgaugaacaagcugauccccgagaugauggagcgccccguggagcagaugacccugcugaacgagauggggcuggugaagaaggacaagaagcgcuucgagaacaacaaguaccugccauacaaggagaucgccaaggacaucuucaaccccguagccagcaaguccgugcgggaggcccucaagaucgucaacgccgugcugaaaaaguacggccacaucgacuaccugguggucgagaugccccgcgacaaaaaucugaaagaggagcaggacaacaucaaggaguuccagaauaagaacaagaaagccaaggacgccgccuucgaggccuucgucaaaagcgugggguccgagcagcgggugaaggaggcgcucagcaagaaccgcaagcuccagaugaagaugcggcugugguaccaacagcaggagaucgaccccuacaauggcaagaccaucgacgccaccgaccuaaucaacaacccggacaaguuugagaucgaccacaucaucccccaguccaucagcuucuaugacuccaucaacaacaagacgcugugcuucgccagcaugaaccaggugaaggggcagaagacccccuacgaguucaugcuggagggccacggccaguccuacgacaaguucaaggccaccgugauggcgaacaagaacuuugggaaggccaagcgcgccaauuaccucuucgaggagaacgucagcgacaucgagacccggaagcgcuuccugucccggaaccugguggacacgcgcuacagcucccgggugguucucaacagccugcaggacuucuuccgcgagaaguccgccgacaccaaggugaccgugauccggggcaaguucaccagcaacaugcgcaagcacuggcacaucgacaagacgcgggagaccuuccaucaucacgccaucgacgcguccaucaucgccgccacccccuuccugcgcauguggaagaagggcgggaccaucuucccggucaaggugggagaggagagcaucgacaucgagacgggagagauacucgacgacaagaacuucgacaaggccauguacgaggagcccuauuccggcuucgugagcgagaucaugaacgccgacgaccggaucaaguucagccaccaggucgacaagaagaugaaccgcaagguguccgacgcgaccaucuacagcacccgcaccgggaagcuggccaaggacaagaaggacgccgaguacaucguggccaaggucaaggacaucuacuccguggacggcuucaagaaguucaagaagguguacgacaaggacaagaccaaguuccugcucuacaaguacgacccacggacguucagcaagcuggagcgcaucaucuccgacugccccgacaaggucgagaaggugcagaccaacgggaaggugaaggccgucgacaucagcccguucgagauguaccggcgcgaccacggcaugaucaagaaguauuccaagaagggcaacgggcccgcgaucaagcagcugaaguaccucgacaagaagcugggcagccacaucgacaucacccccgccaacgccaaugggaagcacgugauccugcaguccuuaaagcccuggcggaccgacguguaccugaaccacgagaccggcgaguaugagaucauggggaucaaauacagcgaccugaaguucaacaagaacgagggcuacggcaucaagaaggacaaguaccucgagaucaagaaggucgaggagguguccgagaaguccgaguucauguuuagccuguaccgcaaggaccgggugaagguccaggacaugaagaccggggagagcguggagcuccuguucuggucccgcaacuucagcaacaagaaguaugcggagcugaagccgaucucccaggcggagaacgacaagaagcugcccguguaugguaaggggcggcucaucaagcgccugauccccaagaacugcaagaucuggaaggucaacaccaccauccugggcgacccguacuaccucgagaaggagagcgacagccccaaggacauccuggacuga

SEQ ID NO: 7419 - RNA, 3366 nt, Artificial Sequence
  Cas9 variant
augagcgaccuggugcucggccuagacauagggauaggcucagucgggguuggcauccugaacaaggugaccggugaaaucauacacaagaacagccgcaucuuuccagccgcgcaagccgagaacaaucucgucaggagaaccaacagacaaggccgcaggcugacuagaaggaagaagcaccgccgagugcgccuaaaucgccucuucgaggaauccggccugaucaccgacuucacaaaaaucagcauuaaucugaaccccuaccagcuccgggugaaaggucugacggacgagcuuuccaacgaggagcuguucaucgcccugaaaaauauggucaagcaccggggcaucagcuaucuggacgacgccuccgacgacggaaacucuaguaucggugacuacgcccagaucgugaaggagaacagcaagcaacucgaaacgaagaccccgggacagauacagcuggagcgcuaccagacauacggccaacugcgcggagacuucaccguggagaaggacgggaagaagcaccgccucauuaaugucuuucccacguccgccuaccggagcgaagcgcuacgcauccuucaaacccagcaggaguucaacccccaaauuacugacgaauuugugaaucgguacuuagagauccugacugggaaacggaaguacuaccacgggccggguaacgaaaagucccggacggauuauggcagauaccgcacgaacggggaaacccuggacaacaucuucggcauccucaucggcaagugcaccuuuuaccccgaugaguuccgggccgccaaggccagcuacacggcacaggaguucaaccuccugaacgaccucaacaaccucacggugccgaccgagaccaagaagcuguccaaggagcagaagaaucaaaucaucaauuacguuaagaacgaaaaggcuaugggaccagcaaagcuguuuaaguacaucgccaaacuccugagcugcgacguggccgacaucaaggguuaccgcaucgauaagagcggcaaggcggagauccacacguucgaggcauaucguaagaugaagacccucgagacccuggauauugagcagauggacagggagacucuggacaagcucgcauacgugcuaacgcuaaacacagagagagagggaauccaagaggcucucgagcaugaguuugccgacggguccuucucucagaaacagguggacgagcugguccaguuccgaaaagcuaauucuagcaucuucggcaaagguuggcacaacuucagugugaaacugaugauggaacucaucccggagcuguacgagaccuccgaggagcaaaugaccauccugacgcggcucggcaagcagaagaccaccuccagcuccaacaagaccaaguacaucgacgaaaagcugcugacggaggagaucuacaacccuguugucgccaagagcgugcgccaggccaucaagauagugaacgcugcgaucaaggaauacggggacuucgacaacaucgugaucgagauggcucgggagaccaacgaggacgacgagaagaaggccauccagaagauccagaaggccaacaaggacgagaaggacgccgcaaugcucaaggcggccaaucaguacaauggcaaggccgaacugccccacuccguauuccacggccacaagcagcuagcaacuaagauccgccuguggcaccagcagggggagagaugccucuacaccggaaagacuaucagcauccacgaccugaucaauaacucaaaccaguucgaagucgaccacauccuaccccucagcaucaccuucgacgacagccuggcuaacaaggugcugguauacgcaaccgccaaccaagagaaggggcagagaaccccguaccaggccuuagauucaauggacgacgccugguccuuccgggagcugaaggcguuuguucgcgagucaaagacccuguccaauaagaagaaggaguaucuucugacggaggaagacaucagcaaguuugacgugcguaagaaguucaucgagcgcaaccuagucgacaccagauacgccagucgcgugguguugaacgcccugcaagagcacuuccgggcccacaaaauugacaccaaggucagcguggugcggggccaguucaccucccaacugcgccggcacugggggauugagaagacgcgagacaccuaccaccaccacgcgguggaugcguugaucaucgcugccagcagccagcugaaccuguggaagaagcagaagaauacccucguguccuauagcgaagaccaauuauuggacauugaaaccggggagcucaucucagacgacgaguacaaagaguucguguucaaggccccauaccaacacuucgucgacacacuuaagucuaaggaguucgaggauuccaucuuauucagcuaccagguggacuccaaauucaaccggaagaucagcgacgcaaccaucuacgcgacccgccaggcuaagguuggaaaggacaaggccgacgagaccuauguccuugggaaaauaaaggacaucuacacgcaggacggcuacgacgcauucaugaaaaucuacaagaaggacaaguccaaguuccugauguaccggcaugacccccagaccuucgagaaggugaucgagcccauucuggagaacuaccccaauaaacaaaugaacgagaagggaaaggaggugcccugcaaccccuuccucaaguacaaggaggagcacggcuacauacguaaauacagcaagaaaggcaacggccccgaaauuaaaagucuaaaguacuacgacagcaagcugggcaaccauaucgauaucacuccgaaggacucaaacaacaaggucgugcuccagagcgugucccccuggcgagcggacgucuauuucaacaauaccacggggaaguacgaaauccugggcuugaaguacgccgaccuccaguucgagaaggggacaggcaccuacaagauuagccaagaaaaauacaacgacaucaagaagaaggagggcguggacuccgacagcgaguucaaguucaccuuauacaaaaacgaccugcuccucgucaaagaaacagagaccaaggaacagcagcuguuccgcuuccucagccggaccaugcccaagcaaaaacacuacguagagcugaagcccuacgacaagcagaaauucgagggcggcgaggcgcugaucaaggugcuaggcaacguggccaacggagggcagugcaucaaaggcuugggcaaaucgaauaucagcaucuacaaggucagaaccgauguauuggggaaccagcacaucauaaagaacgaaggcgacaagccgaagcucgacuuuuga

SEQ ID NO: 7420 - RNA, 3366 nt, Artificial Sequence; identical to SEQ ID NO: 1620
  Cas9 variant

SEQ ID NO: 7421 - RNA, 3366 nt, Artificial Sequence
  Cas9 variant
augaacggccuggugcucgggcuggacaucggcaucgccagcgucggggugggcauccuggagaagaacucagggaagaucauccaugccaacucucgacucuuccccgcggccaccgccgacaacaacguggagcggcgcaagaaccggcaggcccgccggcugaaccgccggaagaagcaccgcggcguccgguuccaggaccuguucgaggacuacggccuucugaccgacuucuccaaggugagcaucaaccugaacccguaccgccuccggguggacgggcugaaccagcagcugacgaacgaggagcuguucaucgcucucaaaaauaucgucaagcgccggggcaucucguaccuggacgacgcgagcgaggacgggggcgccguguccagcgacuacgggaaggccguggaggagaauaggaagcuccuggcagagcagacccccggccagauccagcuggagcgguucgagaaguacggccagguccgcggggacuucacggugguggagaacggcgagaagcggcgccucaucaacgucuucuccaccagcgcguaccggaaggaggccgagaagauccugcgcaagcagcaggaguucaacaaccaaaucacggacgaguucaucgaggacuaccugaagauccucaccggcaagcgaaaguacuaccacggccccggcaacgagaagucccgcaccgacuacgggcgcuuccggaccgacggcacgacccuggacaacaucuucggggugcugaucggcaagugcaccuucuaccccaacgaguaccgcgccagcaaguccagcuacaccgcccaggaguucaaccuccugaacgacuugaacaaccucacggugccgaccgagaccaagaagcuguccgaggagcagaagaaggucaucguggaguacgccaaggaggcgaagacccugggggccagcacgcugcugaaguacaucgugaagaugaucgacgccuccgucgaccagaucagcggcuaccggguggacgugaacaacaagcccgagaugcacaccuucgaggucuaccggaagaugcagucccuggagaccaucagcgugggcgagcucagccggaacgugcuggacgagcuggcccacauccucacccugaacacggagcgcgaggggaucgaggaggccaucaacuccaaacugaugggcgucuucagccaggaccaggugcucgagcugguccaguuccggaagaauaacuccagccuguucuccaagggguggcacaacuucagccucaagcugaugauggagcugauccccgagcucuacgagacguccgaggaacagaugacaauccugacccgccugggcaagcagaaguccaaggagacgagcaagcggaccaaguacaucgacgagaaggagcucaccgaggagaucuacaaccccgugguugccaagagcguccgccaggcgaucaaaaucaucaacgaggccaccaagaaacacgggaucuucgacaacaucgugaucgagauggcccgggagaacaacgaagaggacgccaagaaggacuacaucaagcgccagaaggcgaaccaggacgagaagaacgccgccauggagaaggccgccuuccaguacaacggcaagaaggagcugccgggcaacaucuucaacgggcacaaggagcuggcgacgaagauccggcuguggcaccagcagggcgagaagugccuuuacaccgggaagaccauccccaucuccgaccugauccacaaccaguacaaguacgaaaucgaccacauccugccccucagccuuuccuucgacgacagccuguccaacaaagugcuuguccacgccaccgccaaccaggagaagggccagcgcacgcccuuccaggcccuggacagcauggacgacgcgugguccuaccgggaguucaagagcuacgugaaggaccugaagucacucagcaacaagaagaaggacuaccugcugaccgaggaggacauuagcaagaucgaggugaagcagaaguucaucgagcgcaaccucgucgacacgcgguacuccagccgcguggugcugaacgcccugcaggacuuuuacaagucccaccaguucgacaccacgaucagcgucguccgggggcaguuuaccucccagcuccgccgcaaguggggccuggagaagucucgggaaaccuaccaccaccacgccguggaugcccugaucaucgccgcgagcagccagcuacgccuguggaagaagcagaacaacccgcugaucaccuacaaggagggccaguucaucgacagccagaccggggagauaaucagccucacggacgacgaguacaaggagcuggucuucaaagccccguacgaccacuucguggacacccugcacuccaagaccuucgaggacggcauccucuucagcuaccagguggacuccaaguacaaccggaagaucagcgacgccaccaucuacgccacgcgcaaggccaagcuggacaaggacaaguccgaggagaccuacguccuggggaagauaaaggacaucuacagccaggcgggcuacgacgccuucauuaagaucuacaacaaggacaagcggaaguuccucauguaccacaaggacccccagaccuucgagaaggugaucgaggaaauccugcgcaccuaccccuccaaggagcggaacgacaagaacaaggaggucccgugcaaccccuucgagaaguaccgccaggagaacggccccauccggaaguacagcaagaaggggaacggccccgagaucaagugccugaaguacuacgacaacaagcucgggaauuacauugacaucagcccggacggcuccgacaaccagguggugcugcagagccuaaagcccuggcgcacggacguguacuucaaccaccagaccaagaaguacgagcucauggggcugaaguacuccgaccugagcuucgagaagggcuccggcaaguacagcaucuccaacgaaaaguacaacuccaucaagcgcaucgagggggucaacgagcaguccgaguucaaguucacccucuacaagaacgaucugauccugaucaaggacagcgagaacaacgagcagaaguuauuccgcuucaacucccggaacgacaccgccaagcacuacguggagcucaagcccuacgacaaggcccgcuucgacggccagcaggagcugaucacgauccucgggaacguggccaagggcgggcagugccugaagggccugaacaagagcaacaucuccaucuucaaggucaagaccgacgugcucggcaagaagcacaucaucaagaaggagggggaugagcccaagcugaaguucuga

SEQ ID NO: 7422 - RNA, 3366 nt, Artificial Sequence
  Cas9 variant
augagcgaccuggugcucggccuggacaucgggaucggcuccgucggggugggaaucuuaaacaaggugaccggggagaucauccacaagaacagccgcaucuuccccgccgcccaggcggagaacaaccucguccggcgcaccaaucggcagggccgccggcugacgcgccggaagaagcaccgcauugugcggcugaaccgccucuucgaggaguccggccugaucaccgacuuuaccaagaucagcaucaaccugaacccguaccagcuccgggugaaggggcugaccgacgagcuguccaacgaggagcuguucauagcccugaagaacauggucaagcaccgcggcaucagcuaccuggacgacgccuccgacgacgggaacagcuccguaggcgacuacgcccagaucgugaaggagaacagcaagcagcucgagacgaagacccccgggcagauccagcuggagcgguaccagaccuacggccaacugcgcggcgacuucaccgucgagaaggacgggaagaagcaccggcucaucaacguguuccccacguccgccuaccgcagcgaggcgcugcggauccugaagacccagcaggaguucaacccccagaucacagacgaguucaucaaccgcuaccucgagauccugacgggcaagcggaaguauuaccacgggccgggcaaugagaagucccgcacggacuacggccgguaccgcaccaacggggagacccuggacaacaucuucggcauccucaucgggaagugcaccuucuaccccgaggaguucagagccgcgaaggccagcuacacggcgcaggaguucaaccugcucaacgaccucaacaaccugacugugcccaccgagaccaagaagcuguccaaggagcaaaagaaccagaucaucaacuacgucaagaacgagaaggccaugggccccgccaagcuguucaaguacaucgccaagcuccucagcugcgacguugccgacaucaagggcuacagaaucgacaagucugggaaggcggagauccacacguucgaggccuaccgaaagaugaagacccucgagacccuggacaucgagcagauggaccgggagacccuggacaagcucgccuacgugcugacgcugaacaccgagcgcgagggcauccaggaggccuuagagcacgaguucgccgacgggagcuucucccagaagcaggucgacgagcuggugcaguuccggaaggcgaacagcagcaucuucggcaaaggguggcacaacuucuccgugaagcugaugauggagcucaucccggagcuguacgagaccucggaggagcagaugaccauccugacgcgccucggcaagcagaagaccacauccagcuccaacaagaccaaguacaucgacgagaagcugcugacggaggagaucuacaaccccgugguggccaaaagcgugcggcaggccauuaagaucgucaacgccgccaucaaggaguacggggacuucgacaacaucgugaucgagauggcgcgcgagaccaacgaggacgacgaaaagaaggccauccagaagauccagaaggccaacaaggacgagaaggacgccgcuaugcucaaggcggccaaccaguacaacggcaaggccgaguuaccccacuccguguuccacggccacaagcagcuggccaccaagauccggcuguggcaccagcagggggagcgcugccucuacaccggcaagacgaucagcauccacgaccugaucaacaaccccaaccaguucgaggucgaccacauccugccgcucuccaucaccuucgacgacagccuggcgaacaaggugcuggucuacgccaccgccaaccaggagaagggucagcggaccccuuaccaggcgcucgacuccauggacgacgccuggagcuucagggagcugaaggcguucguccgggaguccaagacccugagcaacaagaagaaggaguaucuccugacggaggaggauaucuccaaguucgacgugcagaagaaguucaucgagcgcaaccuggucgacacccgguacgccagccgcguggugcucaacgcccugcaggagcacuuccgggcccacaagaucgacaccaaggugucgguggugagaggccaguucaccucccagcugcggcgccacugggggaucgagaagacucgcgacaccuaccaccaccacgccgucgacgcgcucaucaucgccgccuccagccagcugaaccuguggaagaagcagaagaacacccucgugagcuacuccgaggaccagcugcuggacauugagaccggcgagcucaucagcgacgacgaguacaaggaauccguguucaaggcccccuaccagcacuucgucgacacacucaagagcaaggaguucgaggacuccauccuguucagcuaccagguggacuccaaguucaaccggaagaucagcgacgcuaccaucuacgcgacccgccaggccaaggugggcaaggacaagaaggacgagaccuacguccucgggaagaucaaggacaucuacacacaggacggcuacgacgccuucaugaagaucuacaagaaggacaaguccaaguuccugauguaccggcacgacccccagaccuucgagaagguaaucgagccgauccuggagaacuaccccaacaaggagaugaacgaaaaggggaaggaggugcccugcaaccccuuccucaaguauaaggaggagcacggcuacauccgcaaguacagcaagaagggcaacgggccggagaucaagucccugaaguauuacgacagcaagcugggcaaccacaucgacaucacccccaagaacuccaacaacaaggucgugcuccagagcguuuccccuuggcgggccgacgucuacuucaacaagaccacggggaaauacgagauccugggacugaaguacgcggaccuccaguucgagaaggggaccggcaccuacaaaaucucucaggagaaguacaacgacaucaagaagaaggagggcguggacuccgacagcgaguucaaguucaccuuguacaagaaugaccuacuccuggugaaggacacggagaccaaagagcagcagcuguuccgcuuccucagccggaccaugcccaagaagaagcacuacgucgagcugaagccguacgacaagcagaaguucgagggcggggaggcucugaucaaggugcucgggaauguggccaacuccggccagugcaucaaggggcuggccaagagcaacaucuccaucuacaagguccgcaccgacgugcugggcaaccagcacaucaucaagaacgagggcgacaagcccaagcucgacuucuga

SEQ ID NO: 7423 - RNA, 3366 nt, Artificial Sequence
  Cas9 variant
augagcgaucuugugcucggccuggacauagggaucggcuccgucggggugggcauccucaacaaggugaccggagagaucauccacaagaacagccgcaucuuccccgccgcccaggcggagaacaaccucguccggcgcaccaaccggcagggccgccgacugacacgccggaagaagcaccgccgugugcgccugaaccgccucuucgaggaauccggccucaucaccgacuucaccaagaucucaaucaaccugaacccguaccagcuccgggugaaggggcugaccgacgagcuguccaacgaggaacuguucaucgcccugaagaacauggucaagcaccggggcaucagcuaccuggacgacgccucggacgacgggaacagcuccaucggcgacuacgcccagaucgugaaggaaaacagcaagcagcucgagacgaagacccccgggcagauccagcuggagcgguaccagaccuacggccaguugcggggcgacuucaccguggagaaggacgggaagaagcaccgccucaucaacgucuuccccacguccgcuuaccggucggaggcgcugcgcauccugcagacccagcaggaguucaacccccagaucacggacgaguucaucaacagauaccucgagauccugaccggcaagcgaaaguacuaccacgggccgggcaacgagaagucccggacggacuacggccgauaccgcaccagcggggagacccuggacaacaucuucggcauacucaucgggaagugcaccuucuaccccgacgaguuccgggccgccaaggcauccuacacggcgcaggaguucaaccugcugaacgaccucaacaaccugaccgugcccaccgagaccaagaagcugagcaaggagcagaagaaccagaucaucaacuacgugaagaacgagaaggccaugggccccgccaagcuguucaaguacaucgccaagcuccuguccugcgacgucgccgacaucaagggguacagaaucgacaaaucaggcaaggcggagauccacacguucgaggccuaccggaagaugaagacucucgagacccuggauaucgagcagauggaccgcgagacccuggauaagcucgccuacgugcugacgcuuaacacugagcgggagggcauacaggaggcccucgagcacgaguucgccgacggguccuucucucagaagcaggucgacgagcuggugcaguucaggaaggcgaacagcuccaucuucggcaagggguggcacaacuucagcgugaagcugaugauggagcucaucccggagcuguacgagaccuccgaggagcagaugaccaucuugacgcggcucggcaagcagaaaaccaccagcuccagcaacaagaccaaguacaucgacgagaagcugcugacugaggagaucuacaacccuguugucgccaaguccgugcgccaggccaucaagaucgugaacgcugccaucaaggaguacggggacuuugacaacaucgucaucgagauggcgcgggagaccaacgaggacgaugagaagaaggccauacagaagauccagaaggccaacaaggacgagaaggacgccgcaaugcucaaagcggccaaccaguacaacggcaaggccgagcugccccacagcguguuccacggccacaagcagcuggccaccaagauccgccuguggcaccagcagggggagcggugccucuacaccggcaagacgaucuccauccacgaccugaucaacaacucgaaccaguuugagguggaccauauccuuccccucuccauuacguucgacgacucccuagcgaacaagguccuaguguacgccaccgccaaccaggagaaggggcagcgcaccccguaccaggcccucgacuccauggacgacgccuggagcuuccgggagcugaaggcuuucguacgcgaguccaagacccugagcaacaaaaagaaggaguaccuccugacggaggaggacaucuccaaguucgacgugcggaagaaauucauugagcgcaaccugguggacacccgguaugccagccgcgucguguuaaacgcccugcaggagcacuuccgggcacacaaaaucgacaccaagguguccgucgugcgcggccaguuuaccucucagcugcgccggcacugggggaucgagaagacgcgcgacaccuaccaccaccacgccguggacgcgcucaucaucgccgccagcucccaguuaaacuuauggaagaagcagaagaacacauuggucagcuacuccgaggaccagcugcuggacaucgagaccggcgagcucaucagcgacgacgaguacaaggaguccguguucaaggcacccuaccagcacuucgucgacacacucaagagcaaagaguucgaagauuccauacuuuucagcuaccaggucgacuccaaguucaaccggaagaucagcgacgccaccaucuacgcgaccaggcaagccaaagugggcaaggauaaggccgacgagaccuacguccucgggaagaucaaggacaucuacacgcaggacggcuacgacgccuucaugaagauauacaagaaggacaaguccaaguuccugauguaccggcacgauccacagaccuucgagaaggugaucgagcccauccuggagaacuacccgaauaagcagaucaacgagaaggggaaggagguccccugcaaccccuuccugaaguacaaagaggagcacggcuauauccgcaaguacagcaagaagggcaacgggcccgagaucaaaagccugaaguacuacgacagcaagcugggcaaccacaucgacauuaccccgaaggacuccaacaacaaggugguccuccaaagcguguccccguggcgggcggauguuuauuucaacaagaccacggggaaguacgagauccugggccugaaguacgccgaccuccaauucgagaaggggaccggcaccuacaagaucagccaggagaaguacaacgacaucaagaagaaggagggcgucgacagcgacuccgaguucaaguucacacuguacaagaacgaccugcuccugguuaaggacacugagaccaaggagcagcagcuguuccgcuuccucagccggaccaugccaaagcagaagcacuacguggagcuuaaacccuacgacaagcagaaguuugagggcggggaagcccugaucaagguccuggggaacguggccaacuccggccaaugcaagaaggggcugggcaagagcaacaucuccaucuacaaggugagaaccgacguccugggcaaccagcauaucaucaagaacgagggggacaagccgaaauuagacuuuuga

SEQ ID NO: 7424 - RNA, 3366 nt, Artificial Sequence
  Cas9 variant
augagcgaccuggugcucggccucgacaucgggaucggcuccgucggggugggcauccugaacaaggugaccggggagaucauccacaagaacagucgcaucuuccccgccgcccaggcggagaacaaccucguccggcggaccaaccggcagggccgccggcugacgcgccggaagaagcacagacgggugcgccugaaccgccucuucgaggaguccggguugaucaccgacuucaccaagaucagcaucaaccugaacccguaccagcuccgggucaaggggcugaccgacgagcucuccaacgaggagcuguucaucgcccugaagaacauggucaagcaccggggcaucagcuaccuggacgacgccuccgacgacgggaacagcuccgugggcgacuacgcccagaucgugaaggagaacagcaagcagcucgaaacgaagacccccgggcaaauccaacuggagcgcuaccagaccuacggccagcugcggggcgacuucaccgucgagaaggacgggaagaagcaccgccucaucaacguguuccccacguccgcuuaccggagcgaggcgcugaggauccugcagacccagcaggaguucaacccgcagaucacagacgaguucgugaaccgguaccucgagauccugaccggcaagcgcaaguacuaccacgggccgggcaacgagaagucccggacggacuacggccgcuaccgcaccaacggggagacccuggacaacaucuucggcauccucaucgggaagugcaccuucuaccccgaggaguuccgggccgccaaggccagcuacacagcgcaggaguucaaccugcugaacgaccucaacaaccugacgguccccaccgagaccaagaagcuguccaaggagcagaagaaccagaucaucaacuacgugaagaacgaaaaagccaugggccccgccaagcuguucaaguacaucgccaagcuccugagcugcgacguggccgacaucaagggguaccgcaucgacaaguccggcaaggcggagauccacacuuucgaggccuaccggaagaugaagaccuuagagacccuggacaucgagcagauggaccgcgagacccuggacaagcucgccuacgucuugacgcugaacaccgagcgcgagggcauccaggaggcccucgagcaugaguucgccgacgggagcuucucccagaagcaggucgacgaguuggugcaguuccgcaaggcgaacagcucuaucuucggcaagggguggcacaacuucuccgugaagcugaugauggagcucaucccggagcuguacgagacaagcgaggagcagaugaccauccugaagaggcucggcaagcagaagacgaccuccagcuccaacaagaccaaauacaucgacgagaaguuacugaccgaggagaucuauaaccccgugguggccaagagcauccgacaggccaucaagaucgucaacgccgccaucaaggaguacggugacuucgacaacaucgugaucgagauggcgcgggagacgaacgaggacgacgagaagaaggccauccagaagauccagaaggccaacaaggacgagaaggacgccgccaugcucaaggcggccaaucaguacaauggcaaggccgagcugccccacuccguguuccacggccacaagcagcuggccaccaagauccgccuguggcaccaacagggggagcggugccucuacaccggcaagaccaucagcauccacgaccugaucaacaaccccaaccaguucgaggucgaccacauccugccgcucuccaucacguucgacgacagccuggcgaacaaggugcuggucuacgccaccgccaaccaggagaaagggcagcgcacccccuaccaggcccucgacuccauggacgacgccuggagcuuccgggagcugaaggcauucgugcgcgaauccaagacccugagcaacaagaagaaggaguaccuacugaccgaggaggacaucuccaaguucgacgugcggaagaaguucaucgagcgcaaccuggucgacacgcgguacgccagccgcguggugcucaacgcccugcaggagcacuuccgagcccacaagaucgacaccaaggucuccguggugcgcggccaguucaccagccagcugcgccggcacugggggaucgagaagacccgcgacacguaccaccaucacgccgucgacgcgcucaucaucgccgccuccagccagcugaaccuguggaagaagcaaaagaacacccucgugagcuacuccgaggaccagcugcuggacaucgagaccggcgagcucaucagcgacgacgaguacaaggaguccguguucaaggcucccuaccagcacuucgucgacacccucaagagcaaggaguucgaggacuccauccuguucagcuaccagguggacuccaaguucaaccggaagaucagcgacgccacgaucuacgcgacccgccaggccaagguggguaaggacaagaaggacgagaccuacguccucgggaagaucaaggacaucuacacccaggacggcuacgacgccuucaugaagaucuacaagaaggacaaguccaaguuccugauguaccgucacgacccccagacguucgagaaggugaucgaaccgauccuggagaacuaccccaacaaggagaugaacgagaaggggaaggaggugcccugcaaccccuuccucaaguacaaggaggagcacggcuacauccgcaaguacagcaagaagggcaacgacccggagaucaaaucccucaaguacuacgacagcaagcuggggaaccacaucgacaucacccccaaggacuccaacaacaaggucgugcuccagagcgugucccccuggcgggccgacgucuacuucaacaagaccaccggcaaguacgagauccuggggcugaaguacgcugaccuccaguucgagaagggcacggggaccuacaagaucagccaggagaaguacaacgauaucaagaagaaagagggcguggacuccgacagcgaguucaaguucacccuuuacaagaacgaccugcuccuggugaaagacacagagacgaaggagcagcagcuguuccgcuuccucagccggaccaugcccaagcagaagcacuacgucgagcugaagccguacgacaaacagaaguucgagggcggggaggcccugaucaagguccucggcaacguggccaacuccgggcagugcaagaagggccugggaaagagcaacauauccaucuacaagguccgcaccgacguacuggggaaccagcacaucaucaagaaugagggcgacaagcccaagcucgauuucuga

SEQ ID NO: 7425 - RNA, 3366 nt, Artificial Sequence
  Cas9 variant
augaacggccuggugcucgggcuggacaucggcaucgccucugucggggugggcauccuggagaagaacuccgggaagaucauccacgccaacagccgccucuuccccgcggccaccgccgacaacaacguggagcggcgcaagaaccggcaggcccgccggcugcaccgcaggaagaagcaccggggcguccgguuccaggaccuguucgaagacuacggccuccugaccgacuucuccaaggugagcaucaaccugaacccguaccgccuccggguggacgggcugaaccagcagcugacgaacgaggagcuguucaucgcccucaagaacaucgucaagcgcagaggcaucuccuaccucgacgacgcgagcgaggacgggggcaccguguccagcgacuacgggaaggccguggaggagaaccgcaagcuccuggcugagcagacccccgggcagauucagcuggagcgguucgagaaguacggccagguccgcggggacuucaccgugguggagaauggcgagaagcggcgccucaucaacgucuucuccacgagcgcuuaccggaaggaggcggagcgcauccugcggaagcagcaagaguucaacuccaagaucaccgacgaguucaucgaggacugccugaagauccuaaccgggaagcgcaaguacuaccacggccccggcaacgagaagucccguaccgacuacgggcgguuccgcacggacggcaccacccuggacaacaucuucgggauccugauaggcaaaugcaccuucuaccccgacgaguacagagccagcaaggccagcuacaccgcccaggaguucaaucuccugaacgaccugaacaaccucaccgucccgaccgagaccaagaagcuguccgaggagcagaagaaggugaucgucgaguacgccaaggaggcgaagacgcugggggccagcacccuccugaaguacaucgccaagaugaucgacgccuccguggaccagauccgcggcuacagaguggacgucaacaacaagcccgagauccacaccuucgaggccuaccgcaagaugcagagccuggagaccaucuccgugggcgagcucagccggaacgugcuggacgagcuggcgcacauccucacgcugaacaccgagcgcgaggggaucgaggaggccaucaacaccaaguuaaaggacagcuucucccaggaccagguccucgaacuggugcaguuccggaagaacaacagcucccuguucagcaagggcuggcacaacuucucccucaagcugaugauggagcugauccccgagcucuacgagaccagcgaggagcagaugacgaucuugacccgccuggggaagcagaaguccaaggagaucagcaagcggaccaaguacaucgacgagaaggagcucaccgaggagaucuacaaccccguggucgccaaguccgugagacaggccaucaaaaucaucaacgaggccacgaagaagcacggcaucuucgacaauaucgucaucgaaauggcgcgggagaacaacgaggaggacgcuaagaaggacuacaucaagcgccagaaagccaaccaggacgagaagaacgcugccauggagaaggcggccuuccaguacaacgggaagaaggagcuuccggacagcaucuuccacggccagaaggagcuggccacgaagauccggcuauggcaccagcagggcgagaagugccucuacaccgggaagaacauucccaucuccgaucugauccacaaccaguacaaguacgaaaucgaccacauccugccccucagccuguccuucgacgacagccuguccaacaaggugcucgugcuggccaccgcgaaccaggagaaaggccagcgcacgcccuuccaagcccuggacagcauggacgacgccugguccuaccgggaguucaagagcuacgucaaggaguccaagcuccuggggaacaaaaagaaggaguaccuucucaccgaggaggacaucagcaagaucgaagugaagcagaaguucauugagcgcaaccugauagacacccgguacagcucccgcgugguccugaacgcccuccaggacuucuauaaggcccacaaguucgacacaacgaucagcguggugcgcggccaguucaccucccagcugcggcgcaagugggggcuggagaagucccgggagaccuaucaccaccacgcggucgacgcccucaucaucgcagccagcagccagcugcgccuguggaagaagcagaacaacccgcucaucgccuacaaggaggggcaguucguggacuccgagaccggcgagaucaucagccuguccgacgacgaguacaaggaguuaguguuuaaggcucccuacgaccacuucguggacacccucucuuccaagacguucgaggacagcauccuguucuccuaccagguggacagcaaguucaaccggaagaucuccgacgccaccaucuacgccacccgcaaggccaagcuggacaaggagaaguccgaggagaccuacguguuagggaagaucaaggacaucuacagccaggccggguacgacgcguucaucaagaucuacaacaaggacaagagcaaguuccugauguaccacaaggacccccagacguucgagaaggucauagaggagauccugcggaccuaccccagcaaggagcucaacgacaagaacaaggagaucccgugcaaccccuucgaaaaguaccgccaggagaacgggcccauccggaaguacuccaagaagucgaacggccccgagaucaagagccugaaguacuacgacaacaagcugggcaaccacaucgacaucaccccggagagcuccgacaaccaggugguguugcagagccugaagcccuggcgcaccgacgucuacuucaaccaccagacgaagaaguacgagcugaugggacucaaguacuccgaccugagcuucgaaaagggcuccgggaaguacaguaucuccaaccagaaguacaacagcaucaagcggaucgagggcaucgacgagcaguccgaguucaaguucacccuguacaagaacgaccucauccugaucaaggacagcgagaacaacgagcagaagcuguuccgcuucaacucgcggaacgacaccgccaagcacuacauagagcucaagcccuacgacaaggccaaguucgacggggagcaggagcugaucaccauccuaggcaauguggccaagggcgggcgcugccuaaagggccugaacaagagcaacaucuccaucuucaaggugaagacggacguccuggggaagaagcacaucaucaagaaggagggcgacgagcccaagcucaaguucuga

SEQ ID NO: 7426 - RNA, 3366 nt, Artificial Sequence
  Cas9 variant
augaacggccugguucuugggcuggacaucgguaucgccagcgucgggguuggcauccugaacaaggacaccggggagaucauccacaccaacucucgcaucuuccccgccgcgacggccgacaacaacguggagcggcgcaacagccggcaggaccgccggcucaaccgccggaagaagcaccgcggcguccggcugcacgaccuguucgaggacuacgaccuccugaccgacuucuccaaggugagcaucaaccugaacccguaccgccuccgggugcagggccuggacaacucccugaccaccgaggagcuguucauagcccucaagaacaucgucaagcgccgggggaucagcuaccuggacgacgccuccgaggacggcgggguggugagcucugacuacgggaaggccgucgaggagaaccgcaagcuccuggcagagcagacgcccgggcagauccagcuggagcgguucaagaaguacggccaggugcgcggcgauuucaccguggucgagaacggggagaagcggcgccucaucaacguguucagcaccuccgccuaccggaaggaggccgagcgcauccugcguaagcagcaggaguucaacaaccagaucaccgacaaauucaucgaggacuaccugaagauccucacggagaagcgcaaguacuaccacggccccgggaacgagaagucccgcaccgacuacggccgguuccgcaccgacggcaccacgcuggacaacaucuuugggauccucaucggcaagugcaccuucuaccccaacgaguaccgggcgagcaaggcgagcuacaccgcgcaggaguucaaccuccugaacgaccugaacaaccucaccgugccgacggaaaccaagaagcuguccgaggagcagaagaagaccaucgucgaguacgccaagucggccaagacccugggggccuccacucuccugaaguacaucgcgaagaugaucgacgccucgguggaccagauccgaggcuaccgggucgacgucaacaauaagcccgagaugcacaccuucgagguguaccgcaagaugcagucccuggagaccaucagcgugugggaacuuagccggaacauccuggacgagcuggcccacauccucacccugaacacggagcgcgaggggaucgaggaggccaucaacaccaaguuaauggacgucuucucccaggaccaggugcucgagcugguucaguuccggaaaaacaacagcucccuguucagcaagggguggcacaacuucucccgcaagcucaugauggagcugauucccgagcuguacgagaccagcgaggagcagaugaccauccucacgcgguugggcaagcagaaguccaaggagaccagcaagcgcaccaaauacaucgacgagaaggaggucaccgaggagaucuacaaccccguggucgccaaguccgugcggcaggcgaucaagaucaucaacgaggccacgaagaaguacgggaucuucgacaacaucgugaucgagauggcacgcgagaacaacgaggaggacgcuaagaaggacuauaucaagcggcagaaggccaaccaggacgagaagaacgucgcgaucgagaaggccgccuuccaguacaacggcaagaaggagcugccggacagcaucuuccacggacacaaggagcucgccaccaagauccgccuguggcaccagcagggcgagaagugccuguacaccgggaagaacauccccaucuccgaccugauccacaaccaguacaaguacgagaucgaccacauccucccccugagccuguccuucgacgacucgcucuccaacaaggugcuggugcuggccaccgcgaaccaggagaagggccagcggacgcccuuccaggcccucgacagcauggacgacgccugguccuaccgcgaguucaagagcuacgucaaggacuccaagcuacugggcaacaagaagaaggacuaccuccugacagaggaggacaucagcaagaucgaggugaagcaaaaguucaucgagcggaaccugguggacacccgcuacagcucccgcgucgugcucaacacccugcaggacuucuacaaggcccacaaguucgacaccacgaucagcgugguccgggggcaguucacuucccagcugcgccggaaguggggccucgagaagucccgcgagaccuaccaccaccaugcgguggacgcccugaucaucgccgccagcagccagcugcggcucuggaagaagcaggccaacccgcugaucuccuacaaggaggaccaguucguggacagcgaaaccggggagauaaucucccugacggacgacaaguacaaggagcucguguucaaggcgcccuacgcccacuucguggauacccuguccuccaagaaguucgaggacagcauccuguucuccuaccagguggacagcaaguacaaccgcaagaucuccgacgccaccaucuacgccacccggaaggucaagcucgacaaggacaagagcgaggagacguacgugcugggcaagaucaaagacaucuacucccaggccggauacgacgcauucaucaagaucuacaacaaggacaagagcaaauuucugauguaccacaaggauccccagaccuucgagaaggugaucgaggagauccuccgcaucuaccccagcaaggaguucaacgagaaaaacaaggaggucccgugcaaccccuucgagaaguaccggcaggagaacggccccaucugcaaguacuccaaaaagggcaacggucccgagaucaagagccugaaguauuacgacaagaacaucccggaguccuucaucgacaucacccccagcaacuccaagaacaaggugauccugcgccagcucaaccccuggcggaccgacguguacuucaaccaccagaccgagaaguacgagcugcugggccucaaguacgccgaccugcaguucgagaaaaagaccgagaccuacagcaucaccaucgacaaguacaacgagaucaaggagaaggagggggucggcgagcacuccgaguucaaguucacgcuguacaagaacgacuugcuccugaucaaggacauggagaucaaggaggagcagaucuuccgcuuccucagccggaccaugcccaacaagaagcacuacguugagcugaagccguacuacaagggcaacuucgaggggaaggagcgcauaaagguguucaacaccaccuccaacggccggugccugaaggggcucggcaagaaggggcuguccaucuacaagauuaagacggacgucuuaggcaacaagcacuucaucaagaaggagggcgagaagcccaagcucaaguucuga

SEQ ID NO: 7427 - RNA, 3366 nt, Artificial Sequence
  Cas9 variant
auggacaggaccgaggugaacaucgguuucgacaucgggaucagcuccgucggcuggagcgugguggccaccaaguccgggcggauccuggagagcggcgucucccuauucagcggggccuccgcggccaagaaugaggagcgccggaacuuccgccagagccggcgccugcugcggcgccgaaagaaccgcaucuccgaccuuaagaaguaccugaaggagcagagcuucacguacaacggcgagcugcucaacgagaaccccuacgagauuagggugaagggccugacagagaagcuguccaaggaggagaucgcccucgcccuguugcacaucgugaagcgccgcggggucagcuacgaccucggcgacaucgaggaggaggggaccacgggcuccuacaaggagggggugaagaaaaaccagaaacugcugaaggagaagacgccggccgagauccaguuccagcggcucaagaaguuccacaaggugagaggccagaucgcgaucgacgagaacgacgugcuucugaacguguuccccaaccacgccuacguggacgaggcccagcagauccucuacacccagcaggaguucuaccccgagaucaacgagaccuucaucaaccaggucaccgacuucaucagccgcaagcgggacuacuucaucggccccggguccgagaagucccgcacggacuacggcaucuaccggaccgacgggaccacccugcagaaccuguucagcauccucaucggcaaggacaagaucuucccggacgaguucagggccgcgggcaacagcuacacggcccagguguacaacuuacugaacgaccugaacaaccuggccaucgaugacacagagaccgggaagcugaccaagcagcagaaggagaagaucaucauggagcucaagacgaccgagaaguccgugaauaugaugaagcugaucgccaagaccgccggcgucaccguggagcagaucagccgguaccgcaucaaccgcgacggcaagagcgagauccacaacauggcgguguaccggaagauccgcaaggucuuccuggagcucggguacgagaucaacgaguggcccucccagcugcuggacgagcucggggacgcccuuagccugaacacggagaacggcgagauccggcgcauccucaccgacaaccuggccaacaaguacaagauccuggaccagcagcucaucaaccugaucaucgagaacaagaacgccuucacccuguccaccaaccagaaguggcaccgguucagcuacaagacgaugaagauccucauccccgagcugcuggaaaccaacaaggagcagaugaccauccucaccgagaugggccugaugaagaaggaccagcgcaacuacguggggaagaacaagaucgacucagaggcccugcucgagaaccuguacaaccccgugguccgcaagagcacgcggcagaccaugaaacuguucaacacccugcucaagaaguacccgaacaucgcguacguggugaucgagaugccccgggaggacgacgaggacaaggcccgccgggacuacgucaaguuccagaaggacaacgagaaggagaaggacgccgcccugaagaacuucaucauggaguccggcaagagcgaggccgaggugaucgcgaaguaccgccaguccaagaaguuccgcagcaaggugcgccugugguaccagcagauggggcggugccucuacuccggcaaggccaugcccgccgagcgcgucuuccgggacgaccacuucaccgacaucgaccacgugaucccccugagcgucuccuucgacgacgggaugaacaacaaggugcugugccucgccgagaugaaccgccagaaggacaagcaaacgccguacgccuuuuucaacgcgggccacggccagggguuccaggccaugaacgccaugcugaagaacaacaaccggaucagcuccgcuaagaagcgcaaccuccuguucaccgagaaccugaacgaccuggaagugcgcaagcgguucaucgagcgcaaccucgucgacacccgguacgcgagccgcguggugcugaacgagcugcagcaguucgucaaggccaagcagcucgacaccaaggugacggugauccggggcaaguucaccuccaagcugcgcgagaaguggaacaucaacaagagccgggacacccaccaccaccacgccgucgacgccgccgugaucgcgguguccccgaugcuuaaccucugggagaagggggccagcaucauccccaacaaggucggcgagaacgugauugacaucaagaccggggaaaucauaaccgaccacgacuacgaggccgacgucuacgagcugcccuacgccaaguuccucgagcagaucccgaaggucaagaaggacaucaaauuccgccaccagguggacaagaagaagaaccggaaggugagcgacgccacgaucuacaccacgcgcaaggcuaaggucggcaaggacaaggaggagaccgacuacgugcucggcacgaucaaggacaucuacucccuggagggauacgugagcuucaagaagaucuacaacaaggacaaggccaaguuccugauggcccggaucgaccccaagacguucgagaagcucgagaagaucgucgccgaguaccccgagucgauugagguggugcaggacaacggcaaggucgacgugcagaagaucagccccuucgagcuuuaccgcaaggacaacggguucgugaccaaguucgccaagaagaacaacggcccggcggucaaaucccugaaguacuacgacagcaagcucggcuccagcaucgacgugacccccgacaaugccaagaacaagaaggucauccugcagucccugaagcccuggcggacugacgucuacuucaacgaggaaaaccaggaguacgagaucauggggcucaaguacagcgaccugaaguucggcaagaacgggaaguacggcgugccgaaggugcgcuacgaggagaucaagcaggaggaggagaucuccgaggggagcaaguuccuguucucccucuaccggggcgaccgcaucaaggucaccaacgagcugggcgagaaccuggaccuccuguucagcucccggacccugccggcccagaagggguacguggaacucaagcccaucgacaagacuaaguuugacggcaaggagaaagugagcuucuacgggacgguuacccccaacggccaguucgugaagaaguucgccaagaagggguacaagaucuugaagcugaacaccgacgagcucggcaacacuuacaucgagaacggcgaaaaggagcccuccgacauacuggacauguga

SEQ ID NO: 7428 - RNA, 3366 nt, Artificial Sequence
  Cas9 variant
augaacggccuggugcucgggcuggacaucggcaucggcagcgucggcguggggauccugaacaaggacaccggagagaucauccacgccaacucccgcaucuuccccgccgcgaccgccgacaacaacgugguccggcgcagcucccggcagggccgccggcucaaccaccgcaagaagcaccggagcgugcgccugaaggaccuguucgaguacuacgaccuccugacggacuucuccaaggugagcaucaaccugaacccguaccggcuccgcguuaacgggcugaaccagcagcugaccaacgaggagcuguucaucgcccucaagaacaucgugaagcggcgcggcaucuccuaccuggacgacgccagcgaggacgggggcgcuguguccagcgacuacgggaaggcggucgaggagaaccggaagcuccuggcagagcagacccccggccagauccagcuggagcgcuucgagaaguacggccaggugcgcggggacuucaccguggucgagaacggggagaagcggcggcucaucaacguguucuccacgagcgccuacaagaaggaggccgagcgcauccugcggaagcagcaggaguacaacaaccagaucauggacgaguuuaucgcggacuaccugaccauccucaccgggaagcgcaaguacuaccacggccccggcaacgagaagucccggaccgacuacgggcgcuuccgaacggauggcaccacccuggacaacaucuucgggauccugaucggcaagugcaccuucuaccccgagaaguaccgggccagcaaggccuccuauacggcccaggaguucaaccuccugaacgaccugaacaaccucaccgugccgacagagaccaagaagcugagcgaggagcagaagaagacuaucgucgaguacgccaaguccgcgaagacccugggggccagcacccuccugaaguacaucgccaagaugaucgacgccuccguggaccagauacgcggcuaccggguggacgucaagaacaagcccgagaugcacaccuucgagguguaccgcaagaugcagagccuggagacgaucagcgugggcgaguucucccgggagguccucgacgaguuagcccacgugcugacccucaacaccgagcgcgaggggaucgaggaggcgaucaacaccaaacuacgggacagcuucucccaggaccagauccuggagcucgugcaguuccgcaagaacaacagcucccuguuuagcaagggcuggcacaacuucucccugaaacucaugauggagcugauccccgagcuguacgagacgagcgaggagcagauggccauccucacccggcuggggaagcagaaguucaaggagacauccaagcgcaccaaguacaucgacgagcaggaggucacggaggagaucuacaaccccguggucgccaagagcgugcggcaagccaucaagauaaucaacgaagccaccaagaaguacggcaucuucgacaacaucgugaucgagauggcgcgcgagaacaacgaggaggaggccaagaaggacuacaucaagcggcagaaggccaaccacgacgagaagaacgccgccauggagaaggcggccuuccaguacaacggggagaaggagcugccggacuccauuuuccacggccacaaggagcucgccaccaagguccgccuguggcaccagcagggcgagaagugccuguacaccgggaagaacauccccaucagcgaccugauccacaaccaguacaaguacgagaucgaccacauucucccccugucucugagcuucgacgacucccuaagcaacaaggugcuggugcuggccacggcgaaccaggagaagggccagcggacccccuuccaggcccucgacuccauggacgacgccuggagcuaccgcgaguucaaguccuacgucaaggacagcaaaagccucgggaacaagaagaaggacuaccugcucaccgaggaggacaucuccaagaucgaggugaagcaaaaguucauagagcggaaccugguggacacccgcuacagcucccggguggugcugaacacgcuccaggacuucuacaaggcccacaaguuugacacaaccaucagcgugguccgcggccaguucaccucccagcugcgccggaagugggggcuggagaagucccgcgagaccuaccaccaccacgccguggacgcgcucaucaucgccgccagcagccagcugcggcuguggaagaagcagaacaacccgcucaucuccuacaaggaggggcaguucguggacagcgagacgggcgagaucaucucccugaccgacgacgaguacaaggagcuggucuucaaggcccccuacgaccacuucgucgacacccuccgcagcaagaaguucgaggacuccauccuauucagcuaccagguggacuccaaguuuaaccggaagaucagcgacgccaccaucuacgcgacgcgcaagaccaagcuggacaaggacaaguccgaggagaccuacguacucgggaagaucaaggacaucuacagccagagcggcuacgacgcuuucaucaagaucuacaacaaggacaaguccaaguuccugauguaccacaaggauccccagaccuucgagaaggugaucgaagagauccugcggacguaccccagcaaggaguucaacgaaaagaacaaggagguguccugcaacccguucgagaaguacaagcaggaaaacgggcccauccgcaaguacagcaaaaagggcaacggccccgagaucaagucccucaaguacuacgacaagaacauccccgagagcuucauuaacaucaccccguccaacagcaagaacaaggucauccugcggcagcugaaccccuggcgcaccgacguguacuucaaccaccagaccgagaaguacgagcuccuggggcugaaguacgccgaucuccaguucgagaagaagacgggcaccuacuccaucaccaucgacaaguacaacgagaucaaggagaaggagggggugagcgagcacuccgaguucaaguucacccuguacaagaaugaccugcuccugaucaaggauacggagaucaaagaggagcagaucuuccgguuccugagccgcaccaugcccaaccagaagcacuacgucgagcucaagcccuacuacaagggcaacuuugaggggaaggagcggaucaagguguucaacacuaccucuaacggccgcugccugaagggccugcggaagaaggggcucagcauauacaagaucaagacggacgugcuaggcaacaagcacuucaucaagaaagagggggagaagccgaagcugaaguucuga

SEQ ID NO: 7429 - RNA, 3366 nt, Artificial Sequence
  Cas9 variant
augagcgaccuggugcucggucucgacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcacaggaucgugcggcugaaccgccucuucgaggaguccggacugaucaccgacuucacgaagaucagcaucaaccugaacccguaccagcuccgggugaaagggcugaccgaugagcuguccaacgaggagcuuuucaucgcccucaagaacauggucaagcaccgcggcaucagcuaccuggacgacgccuccgacgacgggaacaguuccgugggcgacuacgcccagaucgugaaggagaacagcaagcagcucgagacgaagacccccgggcaaauacagcuggagcgguaccagaccuacggccagcuccgcggcgacuuuaccgucgagaaagacgggaagaagcaccgacucaucaacguguuccccacguccgccuaccgcagcgaggcgcugcggauccuucagacccagcaggaguucaacccccagaucaccgacgaguucaucaaccgcuaccucgagauccugaccggcaagcgcaaguacuaccacgggccgggcaacgagaagucccgcacagacuacggccgcuaccgcaccagcggggagacccuggacaacaucuucggcauccucauagggaagugcaccuucuaccccgacgaguuccgcgccgccaaggccuccuacaccgcgcaggaguucaaccugcugaacgaccucaacaaccugaccgugcccaccgagaccaagaagcugagcaaggagcagaagaaccagaucaucaacuacgucaagaacgagaaggccaugggccccgccaagcuguucaaguauaucgccaagcuccuguccugcgacguggccgacaucaaagaguaccggaucgacaagagcgggaaggcggagauccacacguucgaggcguaccgcaaaaugaagacccucgagacccuggacaucgagcagauggaccgggagacccuggacaagcucgccuacgugcugacgcugaacacagagcgcgagggcauccaggaggcccucgagcacgaguucgccgacggcuccuucagccagaagcaggucgacgagcuggugcaguuccgcaaggcgaacagcuccaucuucgggaagggcuggcacaauuucagcgugaagcugaugauggagcucaucccggagcuguacgagaccuccgaggagcagaugaccaucuugacgcgccucgggaagcaaaagaccaccagcuccuccaacaagaccaaguacaucgacgagaagcugcugacggaggagaucuacaaccccgucguggccaaauccgugcggcaggccaucaagaucgucaacgccgccaucaaggaguacggcgacuucgacaauaucgugaucgagauggcgcgcgagaccaacgaggacgacgagaagaaggccauccagaagauccagaaggccaacaaggacgaaaaggacgccgccaugcucaaggcggccaaccaguacaacgggaaggccgagcugccccacagcguguuccacggccacaagcagcuggccacaaagauccggcuguggcaccagcagggcgagcgcugccucuacaccgggaagacgaucuccauccacgaccugaucaacaacagcaaccaguucgaggucgaccacauucugccccucuccaucaccuucgacgacagccuggcgaacaaggugcuggucuacgccaccgccaaccaggagaagggccagcggaccccguaccaggcucucgacuccauggacgacgccuggagcuuccgcgaacugaaggcguucgugcgggaguccaagacccugagcaacaagaagaaggaguaccuccuaacggaggaggacaucuccaaguucgacgugcgcaagaaguucaucgagcggaaccuggucgacacccgcuacgccagccggguggugcucaacgcccugcaggagcacuuccgcgcccacaagaucgauaccaaggucuccguggugcgcgggcaguucaccagccagcugcggcgccacuggggcaucgagaagacgcgggacaccuaccaccaccacgccgucgacgcgcucaucaucgccgcgagcauccagcugaaccuguggaaaaagcagaagaacacccucguguccuacagcgaggaccagcugcucgacaucgagaccggggagcuaaucuccgacgacgaguacaaggagagcguguucaaagcccccuaccagcacuucgucgacacgcugaaguccaaggaguucgaggacaguauccuguucuccuaccagguggacagcaaguucaaccgcaagaucuccgacgcgaccaucuacgcgacccggcaggccaaagugggcaaggacaaggccgacgagaccuacguccucggcaagaucaaggacaucuacacgcaggacggguacgacgccuucaugaagaucuacaagaaggacaagagcaaguuccugauguaccgccacgacccccagaccuucgagaaggugaucgagcccauccuggagaacuacccgaacaagcagaucaacgagaagggaaaggagguacccgucaaccccuuccucaaguacaaggaggagcacggguacauccggaaguacuccaagaagggcaacggccccgagaucaagagccugaaguacuacgacuccaagcuggggaaccacaucgacaucacuccgaaggacagcaacaacaagguggugcuccaguccgucagccccuggcgcgcggacguguacuucaacaagaccacgggcaaguacgagauccuggggcugaaguacgccgaccuccaguuugagaagggcaccgggaccuacaagaucucccaagagaaguacaacgacaucaaaaagaaggagggcguggacagcgacagcgaguucaaguucaccuuguacaagaacgaccugcuccuagucaaggacacagagaccaaggagcagcagcuguuccgguuccucucgcgcacgaugcccaaacagaagcacuacguggagcugaagcccuacgacaagcagaaguucgagggcggggaggcccugaucaaagugcucggcaacgucgccaacagcgggcaaugcaagaagggccugggcaaguccaacaucagcaucuacaaggugcggaccgacgugcugggcaaccagcacaucaucaagaacgaaggcgacaagccgaagcucgacuucuga

SEQ ID NO: 7430 - RNA, 3366 nt, Artificial Sequence
  Cas9 variant
augaacggccugguguuagggcuggacaucggcaucgccagcgucggggugggcauccuggagaagaacuccgggaagaucauccacgccaacagccgccucuuccccgcggccaccgccgacaacaacguggagcggcgcaagaaccggcaggcccgccggcugaaccgccggaagaaacaccguggcguccgguuccaggaccuguucgaggacuacggccuccugaccgacuucuccaaggugagcaucaaccugaacccguaccgccuccggguagacgggcucaaccagcaacuaacgaacgaggagcuguucaucgcccucaagaauaucgucaagcggcgcggcaucuccuaucuggacgacgcgagcgaggacgggggcgccguguccagcgacuacgggaaagccguggaggagaaccgcaagcuccuggccgagcaaacccccggccagauccagcuggagcgguucgagaaguacggccagguccgcggggacuucaccgugguggagaacggcgagaagugccggcucaucaacgucuucuccaccagcgcguaccgcaaggaggccgagaagauccugaggaagcagcaggaguucaacaaccagaucacggacgaguucaucgaggacuaccugaagauccucaccgggaagcguaaguacuaccacggccccggcaacgagaaaucccggacugacuacgggcgcuuccgcaccgacggcacgacccuggacaauaucuucgggguccugaucggcaagugcaccuucuaccccaacgaguaccgggccagcaaguccagcuacaccgcccaggaguucaaccuccugaacgaccugaacaaccucacggugccgaccgagaccaagaagcuguccgaggagcagaagaaggucaucguggaguacgccaaggaggcgaagaccuugggggccagcacucuccugaaguacaucgugaaaaugaucgaugccuccgucgaccagaucucgggcuaccgcguggacgugaacaacaagcccgagaugcacaccuuugaggucuaccggaagaugcagucccuggagaccaucagcgugggcgagcucagccgcaacgugcuggacgagcuggcccacauccucacccugaacacggagcgggagggaaucgaggaggccaucaacuccaagcugaugggcgucuucagccaggaccaggugcucgagcugguccaguuccgcaagaacaacuccagccuguucuccaagggguggcacaacuucagccucaagcugaugauggagcugauccccgagcucuacgagacguccgaggagcagaugaccauccugaccagacuggguaagcagaaguccaaggagacgagcaagcgcaccaaguacauagacgagaaagagcucaccgaggagaucuacaaccccgugguggccaagagcguccggcaggcgaucaagaucaucaacgaggccaccaagaagcauggaaucuucgacaacaucgugaucgaaauggccagagagaacaacgaggaggacgccaagaaggacuacaucaagcggcagaaggcgaaccaggacgagaagaacgccgccauggagaaggcagccuuccaguacaacggcaagaaggagcugcccggcaacaucuucaacggccacaaggagcuggcgacgaagauccgccuguggcaccagcagggcgagaagugccucuacaccggcaagaccauccccaucuccgaucugauccacaaccaguacaaguacgagaucgaccacauccugccccucagccuguccuuugacgacagccuguccaauaagguguuaguccacgccaccgccaaccaggagaagggccagcggacgcccuuccaggcacuggacagcauggacgacgcgugguccuaccgcgaguucaagagcuacgugaaggaccuuaagucccucagcaacaagaagaaggacuaccugcugaccgaggaggacaucagcaagaucgaggugaagcagaaguucaucgagcggaacuuaguugacacccgcuacuccagccggguggugcugaacgcccugcaggacuucuacaagucccaccaguucgacacaacaaucagcgucgugcgcgggcaguucaccucccaacuccggcgcaaguggggccuggagaagucccgcgagaccuaccaccaccacgccguggacgcccugaucaucgccgcgaguagccagcuccggcuguggaagaagcagaacaacccgcugaucaccuacaaggagggccaguucgucgacucccagaccggggagaucaucagccucacggacgacgaguacaaggagcugguguucaaggcccccuacgaccacuucguggacacccuccauucuaagaccuuugaggacggcauccucuucagcuaccaggucgacuccaaguacaaccgcaagaucagcgacgccaccaucuaugcgacgcggaaggccaagcuggacaaggacaaguccgaggagaccuacgugcuggggaagaucaaggacaucuacagccaagcgggcuacgaugccuucaucaagaucuacaacaaggacaagcgcaaguuccucauguaccacaaggacccccagaccuucgagaaggugaucgaggagauccugcggaccuaccccuccaaggagcguaacgacaagaacaaggaggucccgugcaaccccuucgagaaguaccggcaggagaacgggcccauccgcaaguacagcaagaaggggaacggccccgagaucaagugccugaaguacuacgacaauaagcucgggaacuauaucgacaucagcccugacggcuccgacaaccaggugguccugcagagccugaagcccuggcggacggacgucuacuuuaaccaccagaccaaggaguacgagcucauggggcugaaguacuccgaccugagcuucgagaagggcuccggcaaguacagcauuuccaacgagaaauacaacagcaucaagcgcaucgagggggugaacgagcaguccgaguucaaguucacccucuacaagaacgaccugauccugaucaaggacagcgagaacaacgagcagaagcuguuccgguucaacucccgcaacgacaccgccaagcacuacguggagcucaagcccuacgacaaggcccgguucgacggccagcaggagcugaucaccauccucgggaacgucgccaagggcgggcagugccugaagggccugaacaagagcaacaucaguaucuucaaggugaagaccgacgugcucggcaagaagcacaucaucaagaaggagggggacgagcccaagcugaaguucuga

SEQ ID NO: 7431 - RNA, 3366 nt, Artificial Sequence
  Cas9 variant
auggcagacaaaacccuaggggcccucacauucggauucgacauagggauagcauccgucggcuggugcguacucggcgaaaauagaaucgucgaucucggaguccgagcguucgacaaagccgaaacggcgaaagaaggagaauccuugaaucuggcgcgacgaacugcccgccuaaugcgcagaagauuacgacguagagcguggaggcucacaaaacucgcgaggcuuuuaaaacgcgaagggcuaaucgccgacgccuuccagaugcaccaacccucagcgaccagccccuggaaacuacgcguugaagcccucgauagaagacugacagacgacgaaugggccaggguaauauaccaccugugcaagcaccgaggauuccacuggauaagccgagcagaagaaaagaaagccgaaggugaugccaaaggagagucaggacgagucaaaaagggccuaagcgacacacaacgccggaugggcgagaaaggcuaccgaagcgcagcagaaaugguucuagccgaguuccccgaagcccagagaaacaaacagggagacuauggcaaagcccucucacggguacuacuaagcgaagaacuagcucuacuauuccggagacagagagaacucggccauacacacgccucaaaagaacuggaagcagcaauucucggaaacggagacagaaaaggcggacuguucugggcacaaaaaccaccacucgcaggagcggaccuacucaaaaugcuaggaaagugcacauucgaaaaagacgaauacagagcgccaaaagccucauucaccgcagaacgccacguauggcuaacaagacuuaacaaccuccgaguagucgucgacgggacaacacgcccccuaaccgaggacgaaagacgcguagcucuaccgcuaccauacggcuacgccgaugcaaaauuaaccuacaagcaacuccgagcagcccucagcaaagcaggacucucaaacuucuccuucgccgguaucgccgaugacaaagagaaagacacacuuaccaaacuaccagccugggaaacgcuaucgaaaacacucaaaggcaaaggcuuagaaacagaaugggaaggaauggcaggcgcagccacaggaggcgacccaacucuauuagacgagaucucacgcguccucagcguuuauaaggacggcgacgagguagacguagaacucagaaaauugcccuugccaggaggcgagaaaaugguagaaacccuuucagaaaucagcuucgacaaauuccacgcacuaagccugaaggcgcuaaggaagauagugccgcacauggaaacagguuuaagauaugacgaagcaugcgcugcagcaggguaccaccacagccaacuccacgaagcaggagcaggcgggcaaaaauauuugccaccauucuacacccggcgugacaaagacggccgaaugguauucgaugaagaacuagaugucccacgaaaccccgucguccuccgagcccucaaccaagcacgcaagguacuuaacgcacugguacgagccuacggaagcccgagcgcagugcacauagaaauggcccgcgaccucucaaaaccccuagucggccaccccacaccgaacggcggcuacaucgaaggacggcgggacauagaaaaacuccaaaaggaguaccgcgaaagaaacgagaaagacaaagcggcauucgccgccgaacacgggauugcagcaaaauccagggaguucgaaaaauuucaacucuaccgcgaacagcaagguaaaugugccuacucgcuuaagcccuuagaccuccaccgcgugcuccacgacauaggcuacgcagaagucgaccacgcccucccauauucgcgaagcuacgacgacgguaaaaacaacaagguccuaguacucaccgaagaaaaccggaauaagggaaaccguaccgccuacgaauaucucugcgccuucccaggcggcgaaaauggugagcgcuggcgaaacuucgucgcuuacguagaauccaacaaaucuuaucgccuggcgaagagaacuagacuccucagaaaggacuucggagggaaagccgcagaagaguucagagaaaggaaccugaacgacacacgcuacauaugcaaauucuucaaaaacuucguagaaagauuccugcaacuaaaagucggcgccgacggcacagccgcaaaaagaugcgugguccuguccggccaaacaaccgcuuuccuacgggcccguuggggacuacucaaaguaagaggagcaagcgaucgacaccacgcccucgacgccgcagucguggccgccugcagccacggcauggucaaaaggcuggcggacuacagcaggaccaaggaacuggcaaaaguacgcgauggguuccccgacccagaaacaggagaaaucguagacccagcaauguuccaacaacuacacgcccacuucccagaccccuggccucauuuccguggcgaacucgaagcccgccuacagcuagacgacucagcagagcucagagcacagcuagaaauguucggcacauacccggcagaagcccuagagacccuuagaccgcuauucgucucccgcgccccucaacgccggaauggaggcgcagcccauaaagaaacgaucuacgcccaaccugagcgccucaaagaacaaggagguguaacacaaaaagucuccuuagcaagucucaagccaaccgacaucgacaaacucaucgacccgcacagaaacgagaaacucuacgccgcaauccgagcaagguuagaagcacacggcggcaaaagcgacaaagccuuuccagccgacaacccccugcggaaaccugaccgugacgguaauccgacaggcccgaucguacgagccgucacaauggucaucgacaaacugaguggcauucaaauccgcggaggaaucgccaaaaacgacacaaugcuccgagucgacguauuucggcacaagaaagacggaaaauuccaccuagucccacuauacgugcaccacgcagucgcccaagaacuccccaaccgugccaucgucgcguucaaagacgaagacgaauggaccuugauagacgacaacuuccacuuccuauucuccuuccacccaaaugacuucauacggauaacgcagaaaaauaaagcgccaauacucggcuacuacgccagcugccacagaggaacaggaaaccucaaccucugggcccacgacagaaaccaaaaagucgggaaagauggacaaaucgaggggaucggaguaaagacggcgguggcccucgaaaaauuccaugucgacguccucggcaacaucuacccagccccgcccgaacaaagacacggacuagccuga

SEQ ID NO: 7432 - RNA, 3366 nt, Artificial Sequence
  Cas9 variant
augagcgaccucgugcugggccuggacaucgggaucggcuccgucggggugggcauccugaacaaggugaccggggagaucauccacaagaauagccgcaucuuccccgccgcccaggcggagaacaaccucguccggcgcaccaaccggcagggcagacggcugacgcgccggaagaagcaccgccgggugcggcugaaccgccucuucgaggaguccggccugaucaccgacuucaccaagaucagcaucaaccugaacccguaccagcuccgggugaaggggcugaccgacgagcuguccaacgaggagcuguucaucgcccugaagaacauggucaagcaccgggguaucagcuaccuggacgacgccuccgacgacgggaacagcuccgucggcgacuacgcccagaucgugaaggagaacagcaagcagcucgagacgaaaacccccgggcagauccagcuggagcgcuaccagaccuacggccagcugcggggcgacuucaccgucgagaaggacgggaagaagcaccgccucaucaacguguuccccacgucagccuaccggagcgaggcgcugcgcauccuucagacccagcaggaguucaacccccagaucaccgacgaguucaucaaccgguaccucgagauccugaccggcaagcgcaaguacuaccacgggccgggcaacgaaaagucccggacugacuacggccgcuaccgaacuagcggggagacucuggauaauaucuucggcauccucaucgggaagugcaccuucuaccccgacgaguuccgggccgccaaggccuccuacacggcgcaggaguucaaccugcugaacgaccucaacaaccugaccgugcccaccgagaccaagaagcugagcaaggagcagaagaaccagaucaucaacuaugucaagaacgagaaggccaugggccccgccaagcuguucaaguacaucgccaagcuccuguccugcgacguggccgacauaaagggguaccgcaucgacaagagcggcaaggcggagauccacacguucgaggccuaccggaagaugaagacacucgagacccuggacaucgagcagauggaccgcgagacccuggacaagcucgccuacgugcugacgcugaacaccgagcgggagggcauccaggaggcccucgagcacgaguucgccgacggguccuucagccagaagcaagucgacgagcuggugcaguuccgcaaggcgaauagcuccaucuucggcaagggguggcacaacuucucggugaagcugaugauggagcucaucccggagcuguacgagaccuccgaggagcagaugacgauccugacgcggcucggcaagcagaagaccaccagcuccagcaacaagaccaaguacaucgaugagaagcugcugacggaggaaaucuacaaccccgucguugccaaguccguacgccaggccaucaagaucguuaacgccgccaucaaggaguacggggacuucgacaacaucgugaucgagauggcgcgggagaccaacgaggacgaugagaagaaggccauccagaagauccagaaggccaacaaggacgagaaggacgccgccaugcucaaggcggccaaccaguacaacggcaaggccgagcugccccacagcguguuccacggccacaagcagcuggccaccaagauccgccuguggcaccagcagggggagcggugccucuacacaggcaagacgaucuccauacacgaccugaucaacaacagcaaccaauuugaggucgaccacauccugccccucuccaucaccuucgacgacucucuggcgaacaaagugcuggucuacgccaccgccaaccaggagaaagggcagcgcaccccguaccaggcccucgacuccauggacgacgccuggagcuuccgggagcugaaggcguucgugcgcgaguccaagacccugagcaacaagaagaaagaguaccuccugacggaggaggacaucuccaaguucgacgugcggaagaaguucaucgagcgcaaccuggucgacacccgguacgccagccgcguggugcucaacgcccugcaggagcacuuccgggcucacaagaucgacaccaaggucuccguggugcgcggccaguucaccagccagcugcgccgucacugggggaucgagaagacgcgcgacaccuaccaccaccacgccgucgacgcgcucauuaucgccgccagcucccagcugaaccuguggaagaagcaaaagaacacccucgugagcuacuccgaggaccagcugcuggacaucgagacgggcgagcucaucagcgacgaugaguacaaggaauccguguucaaggcccccuaccaacacuucgucgacacgcucaagagcaaggaguucgaggacuccauccuguucaguuaccagguugacucaaaguucaaccggaagaucagcgacgccaccaucuacgcgacccgccaggcgaaagugggcaaagacaaggccgacgagaccuacguccucgggaagaucaaggacaucuauacgcaggacggcuacgacgccuucaugaagaucuacaagaaggacaagucaaaguuccugauguaccggcacgacccacagaccuucgagaaggugaucgagcccauccuggagaacuacccuaacaagcagaucaacgagaaggggaaggaggugcccugcaaccccuuccucaaguacaaggaggagcacggcuacauccgcaaguacucaaagaagggcaacgggcccgagaucaaaucccuaaaguauuacgacagcaagcugggcaaccacaucgacaucaccccgaaggacuccaacaacaaggucgugcuccagagugugucccccuggcgggcggacgucuauuucaacaagaccacggggaaguacgagauccucggccugaaguacgccgaccuccaguucgagaaggggaccggcaccuacaagaucagccaggagaaguacaacgacaucaagaaaaaggagggcguggacuccgacuccgaguucaaguucacccuguacaaaaacgaccugcuccuggugaaggacacggagaccaaagagcagcagcuguuccgcuuccucagccggaccaugcccaagcagaagcacuacgucgagcugaagcccuacgacaagcagaaguuugagggcggggaggcacugaucaaggugcucgggaacguggccaacuccggccagugcaagaaggggcugggcaagagcaacaucuccaucuacaagguccgcaccgauguacugggcaaccagcacaucauaaagaacgagggggacaagccgaagcucgacuucuga

SEQ ID NO: 7433 - RNA, 3366 nt, Artificial Sequence
  Cas9 variant
augaacggccuggugcucgggcuagacaucggcaucgggagcgucggcguggguauccugaacaaggacaccggcgagaucauccacgccaacucccgcaucuuccccgccgcgaccgccgacaacaacgugguccggcgcagcucccggcagggccgccggcucaaccaccgcaagaagcaccggagcgugcgccugaaggaccuguucgaguacuacgaccuccugacggacuucuccaaggugagcauaaaccugaacccguacagacuccgcgucgacgggcugaaccagcagcugaccaacgaggaguuguucaucgcccucaagaacaucgugaagcggcgcggcaucucuuaccuggacgacgccagugaggacgggggcgccguguccagcgacuacgggaaggcugucgaggagaaccggaagcuccuugccgagcagaccccaggccagauccagcuggagcgcuucgagaaguacggccaggugcgcggggacuucaccguggucgagaacggcgagaagcggcggcucaucaacguguuuuccacgagcgccuacaaaaaggaggccgagcgcauccugcggaagcagcaggaguacaacaaccagaucauggacgaguucaucgcggacuaccugaccauccucaccgggaagcgcaaguacuaccacggccccggcaacgagaagucacggaccgacuacgggcgcuuccgcacggacggcaccacccuggacaacauauucgggauccugaucggcaagugcaccuucuaccccgaggaguaccgggccagcaaggccuccuacacggcccaggaguucaaccuccugaacgaccugaacaaccucacugugccgaccgagaccaagaaacugagcgaggagcagaagaagacgaucguugaguaugccaaguccgcgaagacccugggggcuagcacccuccugaaguacaucgccaagaugaucgacgccuccguggaccagauccgcggcuaccggguggacgucaacaacaagcccgagaugcacaccuucgaaguguaucgcaagaugcagcugcuugagacgauccccgugggcgaguuuagccgggagguccuggacgagcuggcucacauccucacccugaacaccgagcgcgaggggaucgaggaggcgaucaacaccaagcugauggacguguucagccaggaccagauccucgagcuggugcaguuccggaagaacaacuccagccuguucuccaagggcuggcacaacuucagccucaagcugaugaucgaacugaucccugagcucuacgaaacguccgaggagcagauggccauccugacccgccuggggaagcagaaguucaaggagacaagcaagcggaccaaguacaucgacgagcaggaggucacggaggagaucuacaacccgguggucgcuaaguccgugcgccaggccaucaagaucaucaacgaggccaccaagaaguacggcaucuucgacaacaucgugaucgagauggcgcgggagaacaacgaggaggaggccaagaaggacuacaucaagcgccagaaggccaaccacgacgagaagaacgccgccauggagaaggcggccuuccaguacaacggggagaaggagcuccccgacagcaucuuccacggccacaaggagcuggcaaccaagguccggcuguggcaccagcagggcgagaagugccuguacaccgggaagaacauccccaucuccgaccucauccacaaucaguacaaguacgagaucgaccacauccugccccugagccucuccuucgacgacagccuguccaacaaagugcuggugcucgccacggcgaaccaggagaagggccgccggaccccguuccaggcccuggacagcauggacgacgccugguccuaccgcgaguucaagagcuacgucaaggacuccaagucucuggggaacaagaagaaggacuaccuccugaccgaggaagacaucuccaagaucgaggugaagcaaaaguucaucgagcggaaccugguggacacucgcuacaguagccgggucgugcucaacacgcugcaggacuucuacaaggcccacaaguucgacaccacaaucuccgugguccgcggccaguucaccagccagcugcgccggaagugggggcucgagaagucccgcgagaccuaccaccaccacgccguggacgcgcugaucaucgccgccagcucccagcugcggcucuggaagaagcagaacaacccccugaucagcuacaaggagggccaguucguugacuccgagacgggcgagaucaucagccugaccgaugacgaguacaaggagcucgucuuuaaggcccccuacgaccacuucguugacacccugcgcuccaagaaauucgaggacagcauccuguucuccuaccagguggacagcaaguucaaccggaagaucuccgacgccaccaucuacgccacgcgcaaggccaagcucgacaaggacaagagcgaggagaccuacgucuuagggaagaucaaggacaucuacucccagagcggcuacgacgccuucaucaagaucuacaacaaggacaaguccaaguuccucauguaccacaaggacccccagaccuucgaaaaggugaucgaggagauccuccggaccuacccguccaaggaguucaacgaaaagaacaaggaggugagcugcaaccccuucgagaaguacaagcaggagaacgggcccauccgcaaguacuccaagaagggcaacggccccgagaucaagagccugaaguacuacgacaagaacaucccggaguccuucaucaacaucacgcccagcaacuccaagaacaaggucauccugcggcagcucaacccuuggcgcaccgacguguacuucaaccaccagaccgagaaguacgagcugcuggggcucaaguacgccgaccuccaguucgagaagaagacuggcacguacagcaucaccauugacaaguacaacgagaucaaggagaaggaggggguguccgagcacagcgaguucaaguucacccuguacaagaacgaccuccugcugaucaaggacaccgagaucaaggaggagcagaucuuccgguucuuaucccgcacgaugcccaaccagaagcacuacgucgagcuaaaaccguacuacaagggcaacuucgaggggaaggagcggaucaagguguucaacaccaccagcaacggccgcugccugaaaggccuccggaagaaggggcuguccauauacaagaucaaaaccgacgugcugggcaacaagcacuucaucaagaaggaaggggagaagcccaagcucaaguucuga

SEQ ID NO: 7434 - RNA, 3369 nt, Artificial Sequence
  Cas9 variant
augaacggcaaaauccuaggucucgacaucggcguagccuccgucggcgugggcauccuggacaagaagaccggagaaaucauccacgccucuagccgcauauuccccgcggccaccgccgacuccaacguggagcggagaggcuuucggcaggggcgcaggcucggucgcagaaagaagcaccgaaagguccggcucgccgaccuguucucugacacgggucugaucacggacuucuccaaggugagcaucaaccucaauccauacgagcugcggaucaagggacuaaacgagaagcucaccaacgaggaacuguucaucgcccugaagaacaucguuaaacggcgcggcaucuccuaccucgacgacgcgaaugaagacggggagagcuccagcuccgaguauggcaaggcggucgaggagaaccggaagcuguuagccgacaaaaccccgggacagauacagcucgagcgcuucgagaaguaugggcaaguccguggcgacuuuacgaucgaggaaaacggggagaagcaccgccugcugaacguguuuuccaccuccgccuauaagaaggaggcagaacggauacucaccaagcagcaggauuacaaccaggacaucaccgacgaguucauccaggccuaccugacgaucuugaccggcaagcgcaaguacuaccacggcccugguaacgagaaaucucguaccgacuacggccgcuuccggaccgacgggacgacgcucgacaacaucuucggcauacugaucggaaagugcaccuucuaccccgaggaguaccgcgccgccaaggccuccuacacagcgcaagaguucaaccugcucaacgaucuuaauaaccugaccgugccgaccgagaccaagaaacucagcgaggaacagaaacggcagaucaucgaguacgccaagggcgccaagacccugggggccgccacgcugcucaaguacaucgcgaagcugguugacgggucgguggaggauauuaaaggcuaccggaucgauaagagugaaaagcccgagaugcacaccuucgacaucuaccggaagaugcagacccuggagaccguagacguggagaagcucucccgggaggugcuggacgaguuggcccacauccucacgcugaauaccgaacgggagggcaucgaagaggccaucaaggucuccuucaucaagcgggaguuugagcaggaccagaucgcagagcuggugagcuuccgcaaauccaacagcucccucuucggcaagggguggcauaacuucagcaucaagcugaugacagagcugauacccgagcucuacgagaccuccgaggagcaaaugacgauccugacccgccugggcaagcaaaagaccaaagcccgcagcaaacggaccaaguacaucgacgaaaaggagcucacagaugagaucuacaacccaguggucgcaaaauccgugcgacaggccaucaaaaucaucaaccuugccaccaagaaguacgggguguucgacaauaucgucaucgagauggcccgggagaacaacgaggaggacgcaaagaaggacuacgugaagcgccaaaaggcgaacgaagaugagaagaacgccgccauggaaaaggccgcgcaccaguacaacgggaagaaggagcuuccggacaauguguuccacggccacaaggagcucgcaaccaagauccggcuguggcaccagcagggggagaagugccuguacacaggcaagaacauccccaucucggaucuuauccacaaccaauacaaguacgagauagaccacauccucccccugucccucagcuucgacgacucccuagcuaacaagguucuggugcuggccacggccaaccaggaaaaggggcagcgcacacccuuucaggcccuagacagcauggaugacgccuggagcuaccgggaguuuaaggccuauguccggggcgcccgggcccugagcaacaagaaaaaggacuaucugcucaacgaagaggacaucaacaagaucgaagugaaacagaaguucaucgagcgcaaccugguggacacccguuacuccagccgcgucgugcugaacgcgcuccaggacuucuacaaacugaacgacuucgacaccaagaucaguguaguccgcggccaguucaccucucagcugcggcgcaaauggcggaucgacaagagccgcgagacguaccaccaccacgccguggacgcgcucaucaucgccgccagcagccagcugcgccuguggaagaagcagggcaacccauugaucuccuauaaggagaaccaguucgucgacagcgagaccggcgagaucauuuccuugaccgacgacgaguacaaggagcuggucuuccgggcgcccuacgaccacuucguggacaccguaagcucaaagaaauucgaggaccggaucuuguucagcuaucagguugacuccaaauacaaccgcaagaucagcgacgccacuaucuacuccacacggaaggccaaacuggguaaggacaagagcgaggagaccuacguccuagggaagaucaaggacaucuacacccagacaggcuacgacgccuucaucaagcuguacaagaaggacaaauccaaauuucucauguaccacaaggaccccaucacauucgagaagguaauagaggaaauccugaaaaccuaccccgacaaggagaucaacgagaaggggaaagaggucgcgugcaaccccuuugagaaguaccgccaggaaaacggcccacuucggaaauacaguaaaaaggggaagggccccgagaucaaaucccugaaauacuacgacaacaagcucgggaaucauaucgacaucacgcccgacaacagcgagaaccaagugauccuccagucccugaagccguggcgaacggauguguacuuuaaccacaagaccaagaucuacgagcugaugggccucaaguacagcgaccuguccuucgagaaggguagcgggaaguaccggaucagccuugacaaguauaacgucaucaagaagaaggaaggcgugcauaaggaguccgaguucaaguucacccuguacaagaacgaccugauccugaucaaggaucucgaaaaguccgagcagcagcuguuccgcuacaacagccggaacgauacauccaagcacuacguggagcugaaacccuacgacaaggcaaaguucgaggggaaccagccccucauggcccuguuuggcaacgucgccaagggcgggcaaugccugaaaggccucaacaaggccaacaucuccaucuacaagguacagaccgacguccuggggaacaaacgguucaucaagaaagagggcgacgcgcccaaacuggaguucuga

SEQ ID NO: 7435 - RNA, 3369 nt, Artificial Sequence
  Cas9 variant
augagcgaccuggugcucggccuggacaucgggaucggauccgucggggugggcauccugaacaaggugaccggggagauuauccacaagaacagucgcauauucccugccgcccaggcggagaacaaccucguccggcgcaccaaccggcagggccgccggcugacccgccggaagaagcaccgcaucgugcggcugaaccgccuguucgaggaguccggccugaucaccgacuucaccaagaucagcaucaaccugaacccguaccagcuccgggugaaggggcugacagacgagcuguccaacgaggagcuguucaucgcccucaagaacauggucaagcaccgcggcaucagcuaucucgacgacgccuccgacgacgggaacagcuccgugggcgacuacgcccagaucgugaaggagaacagcaagcagcucgagacgaagacccccgggcagauccagcuggagcgguaccagaccuacgggcagcugcgcggcgacuucaccgucgagaaggacgggaagaagcaccggcucaucaacguuuuccccacguccgccuaccgcagcgaggcgcugcggauccugcagacccagcaggaguucaacucucagaucaccgacgaguucaucaaucgcuacuuagagauccugaccggcaagcggaaguacuaccacgggcccggcaacgagaagucacgcaccgacuacggccgguaucgcacuaacggggagacccuggacaacaucuucggcauccucaucgggaagugcaccuucuacccggacgaauuucgcgccgcgaaggccagcuacacggcgcaggaguucaaccuguuaaacgaccucaacaaccugaccgugcccaccgagaccaagaagcugagcaaggagcagaagaaccagaucaucaacuacgucaagaacgagaaggugaugggccccgccaaacuuuucaaguacaucgccaagcuccuguccugcgauguggccgacaucaaggggcaccggaucgauaagagcggcaaggccgagauccacacguucgaggcguaccgcaagaugaagacccucgagacccuggacaucgagcagauggaccgggagacccuggacaagcucgccuacguccugacgcugaacaccgagagagagggcauccaggaggcccucgagcacgaguucgccgacggguccuucagccagaagcaggucgacgagcuggugcaguuccggaaggcgaacagcuccaucuucggcaagggguggcacaacuucagcgugaagcugaugauggagcucauccccgagcuguacgagaccuccgaggagcagaugaccauccucacgcgccugggcaagcagaagaccaccagcuccagcaacaagaccaaguacaucgacgagaagcugcugacggaggagauuuacaacccggugguggcgaagaguguccggcaggccaucaagaucgugaacgccgccauuaaggaguacggggacuucgacaacaucgugaucgagauggcucgcgagaccaacgaggacgacgagaagaaggcgauccagaagauccagaaggccaacaaggacgagaaggacgccgccaugcucaaggccgcgaaccaguacaacggcaaagccgagcuuccccacagcgucuuccacggccacaaacaguuagccaccaagauccggcuguggcaccagcagggggagcgcugccucuacaccggcaagacgaucuccauccacgaccugaucaacaaccccaaccaguucgagguggaccacauccugccccucuccaucaccuucgacgacucccuggccaacaagguccugguguacgcgaccgccaaccaggagaaggggcagcggaccccguaccaggcccucgacagcauggacgacgcuugguccuuccgcgagcugaaggccuucgugcgggagagcaagacccuguccaacaagaagaaggaguaccuccugacggaggaggacaucagcaaguucgacguccgcaagaaguucaucgagcggaaccugguggacacccgcuacgcgucccgggugguccucaacgcccugcaggagcacuuccgcgcccauaagaucgacaccaaggugagcgugguccggggccaguucacgucacagcugcgccgccauugggggaucgagaagacgcgggacaccuaccaccaccacgccguggacgcccucaucaucgcggccagcagccagcugaaccuguggaagaagcagaagaacacccucguguccuacagcgaggaacagcugcuggacaucgagaccggcgagcucaucuccgacgacgaguacaaggagagcgucuucaaggcccccuaccaacacuucgucgacacgcugaaguccaaggaguucgaggacagcauccuguucuccuaccagguggacagcaaguucaaccgcaagaucuccgacgccacaaucuacgccacccggcaggcgaaggucggcaaggacaagaaagaugagaccuacgugcucgggaagaucaaggacaucuacacgcaggacggcuacgacgccuuuaugaaaaucuacaagaaggacaagagcaaguuccugauguaccgccacgacccccagaccuucgagaaggugaucgagcccauccuggagaacuacccgaacaaggagaugaacgagaaggggaaggagguccccugcaacccguuccucaaguacaaggaggagcacggcuacauccggaaguacuccaagaagggcaaugggcccgagaucaagagccugaaguacuacgacuccaagcugcucggcaacccgaucgacaucacccccgagaacagcaagaacaagguggugcuccagucccugaagcccuggcgcaccgacgucuacuucaacaagaacacgggaaaauacgagauccucggccugaaguacgccgaccugcaguucgagaagaagaccgggaccuacaagaucagccaggagaaguacaacggcaucaugaaggaggagggcguggacuccgacagcgaguucaaguucacccucuacaagaacgaccugcugcucgugaaggacacugagaccaaggagcagcagcuguuccgguuccugagccgcaccaugcccaacgucaaguacuacguggagcucaaaccguacuccaaggacaaguucgagaagaacgagagccugaucgagauccugggguccgccgacaagagcggccgcuguaucaaagggcucggcaaguccaacaucagcaucuacaaggugcgcacagacgucuuggggaaccagcacaucaucaagaacgagggcgacaagccuaagcuggacuucuga

SEQ ID NO: 7436 - RNA, 3369 nt, Artificial Sequence
  Cas9 variant
augagcaacggcaagauccuggggcucgacaucggcauagccucagugggggucggcgugaucgacgcccagaccggggagaucauccacgcgagcucccgcaucuuccccagcgcuaacgccgcuaacaacgcggagcggcgcaccuuccggggcucccgccggcugauccgccggaagaagcaccgcaucaagcggcuggacgaccucuucaacgacuuccacaucaaccuggacggcgagaugagcacggacaacccguacguucugcgcgucaaggggcucagucaaaagcugaccguggaggagcuguacaucagcaucaagaacaucaugaagcggcgcggcauauccuaccucgacgacgcggaaagcgacaaugaagccgggcgguccgauuacgcaaaggccaucgagcgcaaccgacagcugcugaccagcaagacccccggcgagauccagcucgagcgccuggagaaguacggucagcugcggggcaauuucacaaucaucgacgaggagggacagucccagcaaaucauuaauguguucuccaccucagacuaugucaaggaaguagagaagauccuggacugccagaagauguaccauaaguucaucucggacgaguucugcgacaagcugauagaguuacuccgcgagaagcggaaguacuacguggggccuggcaacgagaaaucccgcacagauuacgggauuuaccggaccgacggcacgaccuuagagaaccuguucggcauccucaucgggaagugcacauucuaccccgaccaauaccgcagcucccgcgcgagcuacaccgcccaggaguucaacuuccugaacgaucugaacaaccucacggucccgaccgagaccaagaagcuaucgcaggagcagaaggaguuccuggugaauuacgccaaggaaaccuccgugcucggcgccgggaagaucuuacaacagaucgccaaguuggcggacugcaagguugaggacauccggggguaccgccucgacaacaaagacaagcccgagcugcacaucuucgagaccuaccgggccaugaagggacuggugccucucguggacaucggcguccugucccgcgagcagcucgacauacucgcggacauccugacccugaauaccgacuucgagggaauccgggaggcccucaagaagcagcugcccaacguguucgacgagaagcaggucaaggggcuggccuccuuccgcaagagcaagucccagcuguucgcgaagggcuggcauaaccucagccaaaagaucaugcuggaaguuaucccugagcucuacgccaccuccgacgagcagaugacgauccugaccagacugggcaaguucgagaaguccagcguggccgaguaccccagcuccaucaacgucgacgagaucaccgacgagaucuacaaccccgucguggccaagagcauccgccagacuaucaagaucaucaacgccuccaucaagaaguggggugaguucgaccagaucgugauugaaaugccccgggaccgcaaugaggacgaagagaagaagcggaucgcggacgggcagaaggcgaacgccaaggaaaaggccgauagcauccuccgcgccgcggaacuguauugcgcgggcaagguacugccggacuacguguacaacggccacaaccagcuggccacgaagaucaggcucugguaccagcagggggagcgcugcaucuacaccggccagcccaucuccauucacgaccugauccacaaccagaaccaguacgagauugaccauauccugcccuuaagccugaccuuugaugacucccugagcaacaagguccucgugcuggcgaccgcgaaccaggagaaggcccagagaacgcccuacaauuaccugaaguccgccaccagcgccuggagcuaccgcgaguucaaggacuacgugaccaagcggaaagggaucggcaagaagaagugcgaguaccucaccuucgaggaggacaucaacggguucgagguccgcucaaaguucauccagcggaaccugguggacacgcgcuacgccucaaaggugauccugaacgcccuccaggacuacuuuaagaucagcggcauccagaccaaggucagcguggugcgcggccaguucaccucccagcugcggcacaagugggggaucgagaagacccgcgagacguaucaccaccacgccguugacgcccugaucauugccgccagcucccagcuccggcuguggaaaaagcaggagagcccguuagugguggacuaccaggagggccgccagguugaccuagagaccggggagauccuggagcugaccgacgagcaguacaaggagcucguguaccagccgcccuaccagggcuucgugaacacgaucucuagcuccgcguucgacaacgagauccuguucagcuaccaggucgacucgaaggugaaccggaagaucagcgacgcgacuaucuacgccacgcgcaacgcccagcugggcaaagacaagaccgaggggaucuacgugcuuggcaagauaaaggacaucuacacccaggccggguacgaggcguuccugaagcgguacaccaaggacaagaccuccuuccugauguaccacaaggaccucgacaccugggagaaggucauagaaaucauccugcgcgacuaccgggaguacgacgagaagggcaaggagaucgggaacccguucgagcgcuaccggcgcgagaacggcuacguaaagaaguacagccggaagggcaacgggaccgccaucaaguccuugaaguacuacgacaacaagcucggcaaucacaucgacaucaccccugagaacagccgcaacgccgugguccugcaaagccugaagccuuggagaacggacguguacuucaacaaggagaccgggaaguacgaguuccuuggcaucaaguacuccgaccugagcuucgagaaggggacuggcgaguauggcaucucccaggaaaaguacgacagcaucaagaucgccgaggggguggcuaagaaguccaucuucaaguucacccuguacaagcaggaccuccuguucauaaaggacaucgagaacaacuucggcaagcugcuccgcuucaccagcaaaaacgacaccuccaagcacuacguggagcucaagcccuacgacaaaaacaaauucgggaccgaggagcccuugcucccagugcugggcaacguggccaagagcgggcagugcaucaagggccugaacaaguccaacaucucuaucuacaaaguccggaccgacauccucggcuaccgccacuucaucaagcaggagggggagcacccccagcugaaguucaagaaguga

SEQ ID NO: 7437 - RNA, 3369 nt, Artificial Sequence
  Cas9 variant
augagcaacggcaagauacuggggcucgacaucggcaucgccuccgugggggucggcgugaucgacgcccagaccggggagaucauccacgcgucuucccgcauuuucccaagcgccaacgccgccaacaacgccgagcggcgcaccuuccggggcucgaggcggcugauccgccggaagaagcaccgcaucaagcggcucgaugaccucuuuaacgacuuccacaucaaccuggacggcgagaugagcacggacaacccauacgugcugcgcgucaaagggcucucccagaagcugaccguggaggagcuguacaucagcaucaagaacaucaugaagcggaggggcaucuccuaccuugacgacgcggagagcgacaacgaggccgggcgguccgacuacgcgaaggcuauugagcgcaaccggcagcugcugacaagcaagacgcccggcgagauccagcucgagcgccucgagaaauacgggcaacugcgggguaacuucacgaucaucgacgaagagggccagucccagcagaucaucaacguguucagcaccuccgacuacgucaaagagguggagaagauccuugacugccagaagauguaccacaaguuuaucagcgacgaguucugcgacaagcugauugagcugcuccgcgagaagcggaaauacuacguggggccgggcaacgagaagucccggaccgacuacgggaucuaccggaccgacgguacgacccuggaaaaccuguucggcaucuuaaucgggaagugcaccuucuacccugaccaguaccgcagcucccgcgcgagcuacaccgcccaggaguucaacuuccuaaacgaccugaacaaccucacggucccgaccgagacgaaaaagcugagccaggagcagaaggaguuccuggugaacuacgccaaggaaaccuccgugcucggcgcagggaagauacugcagcagaucgccaaacuggcggacugcaaggucgaggacauccggggcuaccgccucgacaacaaagacaagcccgagcugcacacguucgaaacguaccgagccaugaagggucucgugccccucguggacaucggcguccugagccgcgagcagcuggacauccuugccgacauccugaccuuaaacacggacuucgagggcauccgggaggcccucaagaagcagcugcccaacguguucgacgaaaagcaggucaaggggcuggccuccuuccgcaagagcaagucccagcuguucgcuaagggcuggcacaaccucagccagaagaucaugcuugaggugaucccggagcuguacgccacguccgacgagcagaugaccauccugacucggcuggggaaguucgagaaguccagcguggccgaguacccaucguccaucaacgucgacgagaucaccgacgagaucuacaaccccgucguggccaagagcauccgccagacgaucaagauuaucaacgccuccaucaagaaguggggcgaguucgaccagaucgugaucgagaugccccgggaucgcaaugaggacgaagagaagaagcggaucgcggacgggcagaaggccaacgccaaggaaaaggccgacagcauccuccgugccgcagaguuauacugcgccggcaagguccugccggacuacguguacaacggacacaaccagcuggccaccaaaauccggcucugguaccagcagggagaaaggugcaucuacaccggccagcccaucuccauacacgaccugauucacaaccagaaccaguacgaaaucgaccacauucugccccucagccugacuuucgacgacuccuugagcaacaagguccucgugcuggcgacagcgaaccaggagaaggcccagcggacccccuacaacuaccugaaguccgcgaccagcgccuggagcuaccgcgaguucaaggacuacgugaccaagcggaaggggaucggcaagaagaagugcgaguaccucacguucgaggaggacaucaacggguucgagguccgcuccaaguucauccagaggaaccugguggacacccgcuacgccagcaaggugauccugaacgccuugcaggacuacuucaagaucuccggcauccagaccaaggucagcguugugcgcggccaguucaccucccagcuccggcacaaguggggaaucgagaagacgcgcgaaaccuaccaccaccacgccgucgacgcccugaucaucgccgccagcucccaacuccgccuguggaaaaagcaggagagcccgcuggugguagacuaccaggaggggcgccaggucgaccucgagaccggggagauccuggagcugaccgacgagcaguacaaggagcuuguguaccagccgcccuaccagggcuucgugaacaccauuuccagcuccgccuucgacaacgagauccuguucagcuaccaggucgacuccaaggugaaccggaagaucagcgaugccacgauauacgccacccgcaacgcucaacugggcaaggacaagaccgaagguaucuacgugcucggcaagaucaaggacaucuacacccaggcaggguacgaggcguuccuuaagagauacacgaaagacaagaccuccuuccugauguaccacaaggaccuggacaccugggagaaggucaucgagaucauccugcgcgacuaccgagaguaugacgagaagggcaaggaaaucgggaaccccuucgagcgcuaucggcgcgagaacggcuacgugaagaaauacuccaggaaaggaaacgggacagccaucaaaucccugaaguacuacgacaacaagcucggcaaucacaucgacaucacuccggagaacagccgcaacgccgugguccugcagagccugaagccuuggcggaccgacguguacuucaacaaggagaccgguaaguacgaguuccucggcaucaaguacuccgaccugagcuucgagaaggggaccggcgaauacggaaucucccaggaaaaguacgacagcaucaagaucgccgaagggguggcgaagaaauccaucuucaaguucacgcuguacaagcaggaccuccuguucauaaaggacaucgagaacaacuucggcaagcuguuacgcuucaccagcaagaacgacaccuccaagcacuacgucgagcuuaagcccuacgacaagaacaaauucgggaccgaggagccccuguugccggugcugggcaacguggccaagucugggcagugcaucaagggccugaacaaguccaacaucagcaucuacaagguccggaccgacauccucggcuaccgccacuucaucaagcaggagggggagcacccccagcugaaguucaagaaguga

SEQ ID NO: 7438 - RNA, 3372 nt, Artificial Sequence
  Cas9 variant
auggccaagauccugggccuagaccugggaaccaauucgauaggcugggcccugaucgacgacgugcaaaacaagauccucggggucggaucccgcaucuuccccaugggcguggagaaccugggcgacggcgacggggagaucagcaagaacgcgucccggacagggacgcgcggcgugcggcgccaauucuuccgacgccggcugcgcaagaaggucuugcugaaggcacugagcgaaaacaacaugugcccgaugauaacauccgacuucgacaacuggaagaagaccaagcaguuccccagcgagaagcucgccuccugguucgcccugaaccccuacgaacugcggaauaaggcccucagcgaaaaguuaacccuggaagagauaggccgcaucuucuaccaccucauccagagaagagguuuucuguccaauagccggaagggcggcacggacgacggugcgaucuucaaaggcaacccaaaggaggggaaaaucggcaucaccgacacccaggaguccauccaggacaaaacccugggaagcuaccucuucgagaucuacccgaaggagaaccagcccuuccagaaugggcuggagcgcauccggaaccgcuacacugugcggaagauguacguggacgaguucgaaaugaucugggagaagcaggcucaauacuacucuaaccugaacgaagaccucaagacccuguucggcgggcgaaagcuggacggcuacaaggaggacgguauccucuuccaccagcggccccugcgcagccagaagcaccuggucggcaacugcguguucgagcccaacaagacaaagugcccgaucuccgcuauccccuucgagcaguuccggguguggcagugggucaacaccguggaguacaacggcaagaagaucagccagguggagaaggagaagaucgucgaguucuuauacgccaacgacaagacggacuucaagaagaucaggaaggcgaucgggaaggagucaacggaguucaaguucaacuacaaggacgacgacaagauuguuggcaccuacaccgugagccaccuaucaaacaagaaguacuucgggaaaaagugguucgaauuuagcgagaaggagcaggaggacaucuggcacauccuguacuucuucgacagcaaguccaaccucaaggaguacgccaucaagaacuggaacuucacggaggaacaggccgagagcaucgccaaguucaacgucaaggacggcuacuccagccugucccgcaaggccaucagcaauauccugcccuuucuaaagcugggguucaccuacgacguggcggugguccuggguggcauuaagaacguguucgggcacgagugggagaagcucuccgacgagaagcggaacuuccugaucgacaacguggagggcaucguccgcagcaagacgaagggcggguuuaucgacgucaucaaggacauccugcggaacgacuacaacaucucugacaaccagcuccgcaagcuguaccaccacagcgccaccaucuauguggccgagcugcucgagaagcugcccgucgggaaggaggccgacaaggagauccaauccauccguaacccgaucgugaucacggcccuguucgagcuccgcaaacuggucaacgagcugaucgacgacuucggcagcaucgacgagaucaagguggagauggcgcgggaccucaagauuucgaaaagccagcgcaacaagauccggcgcgagcagaagcggcuggaacgcgagaacgaccgggugaaggcccgccugcuggaggagggccagaggaucacccacgacaacauccuccuguacaagcugugggaggagugcaagaagaccugcccguacaccgggaaccccaucccucucuacaagcuguucacgggcgagauccagaucgagcacauccacccguggucccgcagccugaaugacuccuucgccaacaagacucucugcuacgccgacgagaaucggaagaagggugacaagacccccuacgaguucuauggcaacgacgagagcaacugguccgccaucaaggagcgcgcgcugaagcuguucagcgacacuaaggaguaccccaacgccuaccagaaguuuaagcgguucguccagcacaaguucgacgacgacuucagcucccgccagcucaacgacacgagauacaucagcaaggaggccaagaacuacuuauccaagauaugcaagaagguggccgucagccccggccaggccaccuccaaccugcggcagaaguggggaaugaacaacauccucaacgacgagaacgagaagacccgcgaggaccaccggcaccacgcgaucgaugcccucgucauggccugcaccaagaucucuuauguacaggagcuguccaaauggaaccgcuacaaccggaacgccgagcucaagaaguucccgcugcccugggagacguucuggagcgacgcaaaccgcgccguugacaagauccugaucucccacaagaaggucagcaacgacaucacuggccggacccauauuucugagaagaacgggaagaaguacaaaaaugugggcguggcagcgcgcgggcagcuccacaaggagaccguauacggcaagcggacguucaacggcgaggaggcuuuccacgugcgcaagaccaucgauagccugaccaccgagaagcagcuggagaagguggucgacgaguccauaaagcuccugaucaagaagcgcgugcaggagcucgggggcuucgugaagggcgcuauccccgccaacaccuucuucgucguggacgagaacgggaucaagcagccccagaucuuccuaccaaacaagaacggggcucccgugcccguccugaaggugcgcaugaaggagaacaucggcggcgccgagaagcugaaggagaacgugaaccagugggucaacccccggaacaaccaccacgugcucauuuacaaagacgagaaggggaaccugaaggaggagguaguaacguucuggaccgugguggagcguaagcggaccggccaaagcgccuaucagcuaccguucgacgggaaggagaucgucaccacacuccacaucaacgacauguuccugcugggccucaaugaggaagaaaucaacugggagaaccccgacuacgaggugcugaaggagcaccuguaccgcgugcagaaguucaccuccggggacuacuacuuccggaucgcgaaaaccuccuccauccagaacgccaucgagaagcagcagaucaacagcuucggcuucggcaaaaacggguggagcacacacaaccccaucaaggucaagaucuccgugucaggcaagaucuccaagguguga

SEQ ID NO: 7439 - RNA, 3372 nt, Artificial Sequence; identical to SEQ ID NO: 1639
  Cas9 variant

SEQ ID NO: 7440 - RNA, 3378 nt, Artificial Sequence
  Cas9 variant
augaauggccuaguucuaggccuagacaucggcauagccucagucggcgucggaaucuugaacaaagaaacaggcgaaaucauccacgucaacucacggauauucccagccgccaccgcugacucaaacguugaacggcgaggcuucagacaaggacgcagacuaggccgacgcaaaaagcaccgcuccgcccgacugaacgaccuauucgaagaguucggguuuauaaccgacuucuccgcagugccgcugaaccucaacccguacgcccucagagucaaaggccucuccgaagaacuaaccaacgaagaacucuucaucgcacuaaagaacauaauuaaacgcagaggaaucuccuaccuagacgacgccagcgaagacggcgaaaccgcaucaaacgaauacggaaaagccgucgaggaaaaccggaaauuacucgcagacaaaacgcccggacaaauccagcucgaacgguuugaaaaauauggacagguacgcggggacuucacggucguagagaacggggagaaccaccgccucaucaauguauuuucgaccucagccuauaagaaagaagcggagcguauccuccgcagacagcaggaguucaacguccgcauauccgacgaguucaucgaagccuaccucacgauccucacaggcaaacgcaaauacuaccauggaccggggaacgaaaaaucacgcaccgacuacggacgguucagaaccgacgguacgacgcucgacaacaucuucgggauacucaucggcaaaugcacauucuaccccgacgaauaccgcgcugccaaggcuuccuacacagcccaggaauuuaaccuguuaaacgacuuaaacaaccuuacaguacccacggaaaccaaaaagcucagaccagaacagaaaagacaaaucgucgaauacgccagaacagcaaaaaccuuagggaccccaacauuacucaaguacaucgccaagcucgucgacggguccaucgacgacaucaaaggauaccgcauagacaaaucagacaaacccgaaaugcacaccuucgaugcuuaccgaaaaaugcgaacccucgagcuagucgacgucgacauccuaagccgcgaaacccucgacgaccuagccuacauccuaacccuaaacaccgaauccgaaggcauacuagaagcccuaaacucaaaaaugccaggaacauucaccaaagagcaaaucgacgaacugauccaauuccguaagaaaaacuccgccguguucgggaaaggguggcacaacuucagccugaaacugaugaacgaacuaauacccgaacuauacgaaacgucagaagaacaaaugacgauucucacccgccugggaaaacaacgcucccgcgaaaucagcaaaagaaccaaauauauagaugaaaaagaacugacugacgagaucuacaaucccgugguagccaaauccgucaggcaagcaaucaaaauaauaaaccuggcaacaaagaaguacggaauauucgacaacaucguaaucgaaauggcccgggaaagcaacgaggacgaugagaaaaaggccauccagaacguccaaaaggcgaacgaagaugagaaaaaggccgcuauggaaaaagccgcagaccucuacaacggaaagaaagaacuucccgauucgauauuccacgggcacaaagaacucgcgacaaaaauacgccuauggcaucaacaaggagaacggugccucuacaccggcaaaaacaucagcauccacgaccuaauacacaacccccaucaauacgaaauagaccacauccuaccccucucccucuccuucgacgaugggcuagcgaacaaaguccuagugcucgccaccgcgaaccaagaaaaaggucaacgcacccccuuccaagcacuggacuccauggacgaugccuggaguuacaucgaguucaaacaauacguuagaaacucaaagagccucucgaacaaaaagaaagacuaccuacuaacggaagaagacaucucuaaaauagaagucaaacaaaaauucaucgaacgcaaucuagucgacacacgauauucgucacgagucguacucaacaccuugcaagaguucuacaaaaccaacgacuucgacaccaaaaucucagucguacgaggccaauucacuucccaauuacgcaggaaguggaaaauagaaaaaucccgagacacauaccaccaccacgccgucgaugcccucauaaucgccgcaagcucucaacuacgacucuggaagaaacaaaacaacccccucaucagcuacagagaaggccagcuagucgauccggagacaggagaaauacugucgcuaacggacgacgaauauaaagaacucguccucaggcccccguaugacuauuucgucgauacgcucaaaagcaagagcuucgaagacuccauccucuucagcuaccaagucgacuccaaauacaaccgaaaaauauccgacgcgacaauuuacggcacccgcaaagcacaacugggcaaagacaaacaagaggaaaccuacguauuaggaaaaauaaaagacaucuauagccaaaaaggguacgaagauuucaucaaacgguacaaaaaggacacaacacaguuccuaauguaccacaaagacccccaaaccuucgccaaaguaauagaagaaauacuaaaaaccuacccagacaaagaacuaaacgaaaaaggcaaagagaucccgugcaacccauuugagaaguaucggcaagaaaauggacccauacggaaauacagcaagaaaggcaaaggccccgagauuaaaucucucaaauacuacgacaacaaacuaggaaaccacauagacauaaccccggugaacagccaaaaccaagucguacuacagucccuaaaacccuggcgcaccgacguauacuucaacccccaaacaaguaaauacgaacuaaugggacucaaauacucugaccuucgguucgaaaaaggguccggaagcuacggcaucucacccgaaaaauacaacaagguuaaagccaaagaggggguugacgaggacuccgaguucaaauucacucuauacaaaaacgaccuaauccuuauuaaggacacugaaacaggggaacaacaacucuuccgcuacggcucccguaacgacaccagcaaacacuacguugaacuaaagccguacgagaaagcaaaguucgaaggcaaccagcaacucaugaaucuccuaggaacaguggcaaagggcgggcaaugccugaaagggaucaauaagccaaaccucuccaucuacaaaguaaaaacugacguccuuggaaacaaauacuucaucaagaaagagggagaccaaccccagcucaacuucaaaaagaaaauauga

SEQ ID NO: 7441 - RNA, 3378 nt, Artificial Sequence
  Cas9 variant
augacaagcaagcaagagaaccugggcgcacucaccuucgggcuagauaucggaauagccaguguaggcugggcaguacuaggugaaaaucgcauaaucgaccugggcguccguugcuuugacaaagcagaaacggcgaaagaaggcgagagucucaaccuagcccgccggauggccagacuguugcgccggagacuccgacggcgagcauggaggcuaacaaaacuggccaggcuccuaaaacgggaaggcuuaauagccgacgccaaccucuucaaaaacaaaauagagaaaaacacacccgucccgaaaagcagcuggcaacuccgagucgacgccuuagacagaaagcuaaacgcugaagaaugggcacgcgugauauaccaccucugcaaacacagaggcuuccacuggauuagcagggcagaagagaaggccgccgagagcgauucaaaaggggaauccgggaaaguaaaacagggccuggccggaacaaagaaacuaaugcaagaaaagaacuaucgcaccgccgccgaaaugguacuagccgaguucccagaagcgcaacggaauaaacaaggagacuacagcaaagcccuaagcaggauccuucuaggagacgagcuaaaaacgcuauuugagcaccagcgcaaacucgacuccccauucgcaaccgaaaagcucgaagccgcaauacuagggaacggagaccgaaagucuggacuguucugggcccaaaacccagcacuggccggcagugaccugcuaaaaaugcugggauacugcacguucgagaagaccgaauaccgagccccaaaagcgucguucaccgcagagagacacguguggcucacacgacuaaacaaccuccgcaucguaguagacggaacaacccgaccacucaacgaggcagaaaggcgcauagcacugcucaugccauaccaacaagcaggggacuucacguacaagcaacugagaaccgcacuaaccaaggccggguuccuaccagaaaguuucagguacacaggacugagcuacgcaagcgggcaaaaagccggcgagaaaacaaaagacccugaauccgcugcccuagucaaguucccagcauggcaagaacugagaaaaacccuagagaaaaaggaacucgccagcgaguggcagaaaaucucgacagacgcccuggacggaaagccccaacuccuagaccaaaucgcauggguccucagcgucuacaaagacgacgaugagguaaaagcagaacuaagcaagcucaaccucccgaacgcagagaaaaugaucgacgcccugcucgacauaagguuugacaaauucucaaaccuaagccuaaaagcccucugcaaaauaguaccccugauggaacaaggacaacgcuacgacgaagcgauagcgaacauaccagaauacggucaccacucacaacuccauaaaguuggcgcgggcgaacacaaauaccuuccgccuuucuacaaagaacgcgacaagaccggaaggaugguauucaacgacgacauggacauaccaagaaaccccgucguccugagggcacuuaaccaggcgcgaaaagucguaaacgcguuaauaaagaaauaugacaguccacacgaaguccacaucgaaauggcacgcgaccuaagccgccccuuagacgaacgccgagaagucgagaaacugcaaaaggaguucagggacaacaacgaaaaaggcaaagcacaauucgcccaggacuucaacauugucggcgcagucaaagggaaggaguucgaaaaguaucaauuauauagagaacaacagggcaaaugcgccuacagcauagagccaauggacauucacagauuauucgagcagggauacguggaaauagaccacgcgcucccguacagcagaucguucgacgacagcaaaaacaaccguguccuaguacuggcaaaggaaaaccgagacaagggaaaccgcacacccuucgaguaccucggaggcaaggacaacagcgaaccguggcggcaguucguagccuuuguagaaggcaauaaagccuaucgccuagcuaaacggagccgacugcuuaggaaagacuucggggacaaagaagcaaaggaguuccgagaaaggaacuuaaacgacacaagguacauaugcaaauucuucaaaaacuacgucgaacaauaccuccaacugcacgaagacucggaagcaaagcgaugcguaguccuaagcggucagaugaccucauuccuuagagcaagaugggguuuaguaaaaguccgaggcgacagcgacaggcaccacgcacuggaugccgccguggucgccgcauguucacacgguaugguaaagaggcucagcgauuacucgagaaggaaagagcuggaacaaguuagagaaggauucguggacgucgauacaggugaaaucgucaacccggcaauguuccagcagguccaggaacauuuccccaaucccuggccacacuuccgagaugaaguaaagcuacgacucagcauggacgaccccgcacuacugcgaagcgaaauggaaaaauucggcacauacacacccgaggccuuacaggcacugcacccacuauucguguccagggccccacagcgccgcaacagcggcgcagcacauaaagacacuaucuaugcccaaccaaagcggcuaguagcccaaggggguguaacacagaaaguagcccuaacaucccucacccugaaggaccucgauaaacugaucgauccacaucgaaacgacaaacuguacacagccauccgagcaaggcuagaacaacacggcggaaagggcgacaaagccuuccccuccagcaacccacuacgcaaacccgacagcgaaggaaaccccacggggccaaucguaagaggaguaacaaugguaaucgacaaacuauccgggaucccaauccgcgggggcauagcgaaaaacgacucaaugguccgcguagacguauucacgaaggccaacaaauuccaccuggugccugucuaugugcaccacacggucgcaaaggcacucccaaaccgagccguagucgccuucaaagaugaggacgaguggacgcucaucgacgacucguucgauuucugcuucagccuccacccgaacgaccuaguccaaguacaacaaaagggaaaagcaggaaugauaggcuauuacagcagcugccacagaggaaccggaaacauaaaccucugggcgcacgaccgaaaccuccaagucggaaaagacggaaugauagagggaauaggagugaaaacagcccuaucgcuagaaaaauucaacgucgacguauuagggaaccgguacccugcaccgcccgagaaaagaagagaccucgccuga

SEQ ID NO: 7442 - RNA, 3378 nt, Artificial Sequence; identical to SEQ ID NO: 1642
  Cas9 variant

SEQ ID NO: 7443 - RNA, 3381 nt, Artificial Sequence
  Cas9 variant
augaacggccuggugcucgggcuggacaucggcaucgccagcgucggggugggcauccugaacaaggagaccggggagaucauccacgccaacuccagaaucuuccccgcggccacggccgacagcaacguggagcggcgcggcuuucggcaaggccgccggcucgggcgccggaagaagcaccgcucagcccggcugaacaaccuguucgaggaguucggcuucaucacggacuucagcgccaucccgcucaaccugaacccguaugcgcugagggucaaggggcucucugaggaguuaaccaaugaggaacucuucaucgcccucaagaacaucaucaagcggcgcggcaucagcuaucuggacgacgccuccgaggacggggagaccgccagcaacgaguacggcaaggcgguggaggagaacaggaagcugcucgccgacaagaccccggggcagauccaguuagagcgcuucgagaaguacgggcagguucggggcgacuucacggucguggagaacggggagaaucaccgccugaucaacguguucuccaccagcgccuacaaaaaggaggcugaacggauccuccgccggcagcaggaguucaacguccggaucuccgacgaguucaucgaggcuuaccugaccaucuugaccgguaagcggaaguacuaccacggccccgggaacgagaagucccgcacugacuacggccgauuccggaccgacgggaccacgcuagacaacaucuucggcauucugaucgggaaauguacguucuauccggacgaguaccgcgcggccaaggccagcuacaccgcacaggaguucaaccuguugaacgaucugaacaaucugaccgugcccaccgaaacgaagaagcucagccccgagcagaagcggcagaucguggaauacgcccgcaccgcgaagacccugggcaccccuacacuacucaaauacaucgccaagcuagucgacggcuccaucgaugacaucaagggguaucggaucgauaagagcgauaagccggagaugaugcacaccuucgacgccuaucggaaaaugcgcacacucgaccucguuaauaucgaugcccugucccgcgaaacccuagacgacuuagcccacauccugacgcuuaacaccgagagcgagggaaucuuagaggcgcugaacuccaaaaugcccagcaccuucacaaaggaacagauugacgagcugauccaauuccggaagaagaauagugccguguucgguaagggguggcacaacuucucccugaagcugaugaacgagcugaucagcgagcucuacgagacguccgaggagcagaugaccauccugaccaggcuggggaagcagcggagccgcgagaucuccaagcggacuaaguauaucgacgagaaggagcucacggaggagauauacaaccccgucguggccaaaaguguacgucaggccaucaagaucaucaacgaggccaccaaacgguacggaaucuucgacaacauugucaucgagauggcccgcgaaaacaacgaggaggacgccaaaaaggauuacaucaagaggcagaaggcgaaccaggacgagaagaacgccuccauggagaaggcggcauuccaauauaacggcaagaaagagcugcccgacagcaucuuccacgggcacaaagagcuggccacaaagauacgccuguggcaccagcagggcgagcggugccucuacaccgggaagaacaucucaauccgcgaccugauccacaacccgcaccaguacgagaucgaccacauccugccccugagccuguccuucgacgacggccuggcuaacaagguucucguccuggccacugcgaaccaagagaagggucagcgcacacccuuccaagccaucgacagcauggaugacgccugguccuaccgcgaguucaagcaguacguccgcaacagcaagucccuuagcaacaagaagaaggacuaccuccugaccgaggaggauaucuccaagaucgaggugaagcagaaguucaucgagcggaaccuggucgacacccgcuacagcagucgggucgugcucaacacccugcaggaguucuacaagacgaacgacuucgacaccaagaucagcgucgugcgcggacaguucaccagccagcugaggcgcaaguggaagaucgagaagucccgagacaccuaccaccaccacgccgucgacgcccucaucaucgcggccagcucccagcugcgccuguggaagaagcagaacaauccccucaucagcuacaaggaaggccaguucgucgacccggagacgggggagauccugucccugacagacgacgaguacaaggagcuugucuuccggccgcccuacgacuacuucguggacacccucaagagcaagucuuucgaggacagcauucuguucuccuaccaggucgacagcaaguacaaccgcaagauuuccgaugccaccauuuacggcacgagaaaggcccagcucgggaaggacaagcaggaggaaacauacgucuuaggcaaaauaaaggacaucuacagccagaagggcuacgaggacuucaucaaacgauacaacaaggacgagacccaguuccugaucuaccacaaggauccccaaaccuucgaaaaggugaucgaggagauccucaagacguaccccgacaaggagcugaacgagaaggggaaggagauccccugcaaccccuucgagaaauaccggcaggagaacggcccuaucagaaaguacuccaagaaggggaagggcccugagaucaagauccugaaguacuacgacaacaagcucgggaaccacaucgacaucacucccgucaacagccagaaccagguggugcugcaauccuuaaagcccuggcggaccgacguauacuuuaacccccgcaccagcaaauacgagcucaugggucugaaguacuccgaccugcgguucgagaagggcagcgggagcuacggcaucuccccggagaaguacaacaaagugaaggccaaggagggcgugaacgaggacucugaguucaaguucacgcucuacaagaacgaccugauccugaucaaggacaccgaaaccggcgagcagcagcuguuucgcuacgggucccggaacgacaccagcaagcacuacguggagcugaagcccuacgagaaagcgaaguucgaggggaaucaacagcuuaugaacuuacugggcacuguggccaagggcggucagugccugaaggggaucaacaagcccaaccucuccaucuacaaggugaagaccgacguccugggcaacaaguacuucaucaagaaggagggggaccagccgcagcugaacuucaagaagaaauuuuga

SEQ ID NO: 7444 - RNA, 3381 nt, Artificial Sequence
  Cas9 variant
auggcaagcaaacacgaaaaccucggcgcgcucacauucggccucgacaucggaauagcaagcgugggaugggcaguacuaggcgaaaaccgcauaaucgaccuuggaguacgcugcuucgacaaggccgaaacagcaaaggagggcgagagccuaaaccuugcgaggagaaccgcaaggcugcuaagacggagauugcggagacgcgccuggcgacucaccaagcuggcacgacuacuuaaaagggaaggccucaucgcggacacaaacgucuuccaaaagccguucaaccuuaaagacgcaaacgaaaagggccugucauucuggcaacugcgaguggacgcguuagaccgaaaacucuccgccgaggaaugggcccgagucauauaccaccuauguaaacaucgaggauuccacuggauaucgcgggcggaagaaaaagcagcagaaggagacaguaaaucggaaggugggaaagugaaacaaggccuagcaggcaccaagaaacuaaugcaagagaaaaacuaccgcacagcggccgaaaugguccucacagaguuccccgaagcacagaggaacaaacaaggggacuacuccaaggcccucagcagaauccuacucggcgacgaaaugacccaacucuucaagcaccagagggaauuaggaaacccccaugcaacagaaaaacuagaagcagcgauacuaggaaacggcgaccacaaaucgggauuauucugggcccagaaccccgcucuagcgggaaaugaccuacuaaaaaugcuggggcacugcaccuuugaaaaagcagaauaccgcgucccgaaagccaguuucacagcagagagacauguguggcugacccgccugaacaaccuaagaaucgugguagacgggacaacacggccgcuaaacgaagccgaaagacaccuggcacuacuuaugcccuaccaacaagccggagaccuaacauacaaacagcuacgcaccgcccuaacuaaagcaggauaccuccccgaauccuuccgauauacaggccuagcuuacgcaucgggacaaaaggcagaugaaaaggcgaaagaccccgaaucagcuccauuaguaaaacuaccagcauggcacgaacuuaggaaaacgcucgagaagaaagagcuggccucagaauggcagaaaaucucauccgacgcccucgacgggaaaccccaacuucuagaccaaaucgcauggguacugagcguauacaaggacgacacagaaguggaggccgaacucugcaaacucaacuugcccaacgcggagaagaugaucgacgcacuccucgacauccgcuucgacaaauucucaaaccucucccuaaaagcccuccgacaaaucguaccccuaauggagcaaggccaacgguacgacgaggcagucgcaaacauaccugaauacggccaccacucccaacuccacgaagugggagccggcgagcacaaauaccucccaccguuuuacaaggagcgcgacaaaacgggccgaaugguguucaacgacgacauggacauucccagaaacccagucguccucagagcacuaaaccaggcacgcaagguagugaacgcccucaucaaagaauacggaagcccgcacgagguccauauagagauggcacgagaccuaucccggccgcucgacgagcgacgcgaugucgagaaacugcaaaaagaguuccgcgaccgcaaugaaaaggacaaagcacuauucgcacaggauuucaauauaguaggagcgguuaaaggcaaagaguucgaaaaauaccaacuguaccgugaacagcaagguaaaugcgcguacaguaucgaacccauggacauccacagacuauuugaacaaggguacguagagauagaccacgcgcuacccuacucccggagcuucgacgacagcaaaaacaaccgagugcuaguauuggccaaagaaaaccgcgacaaaggcaacagaaccccguucgaguaucucggcggcaaagacaacuccgagcguuggcgacaauuugucgccuuuguggaagggaacaaaucguaccggcucgcaaaaagaagccgacuacuacgcaaagacuucggcaaagacgaagccaagggcuuccgagaacggaaccugaaugauacccgcuacaucugcagauucuuuaaaaacuacgucgaacaauacuuacaauuacaugaagacucggacgcgaaacggugcgucguccucucaggccagaugacaucauuccuccgcgcacgauggggccuaguaaaaguacggggcgacagcgaccgucaccacgcccucgacggagcgaucguggcugccugcucacacucaauggucaaacgccucucggacuacagcagacgcaaggaacucgaacagguccgagcuggauucguggacguagacaccggggaaaucguaaacccugcaauguuucagcagguacaagagcacuuccccaaccccuggccccacuuccgagacgaagucaaacucaggcucaacgucgaugacccugcgcuacugcacucagaaaugaacagguucggaaccuauuccccagaggcgcugaaggcgcucagaccacucuucaucuccagagccccacaaagacggaacagcggagcggcacacaaagauacaauauacgcccaaccagagagacucgucgcacaagggggagucacccagaaggucccccuaacaagucucacgcugaaagaccuggacaagcuaauagacccccaccgaaacgagaaacucuacucagccauccgaauaaggcuggaacaacacggcggaaaaggcgacaaggcauucccagcuucaaacccauuaagaaaaccagacuccgaaggcaacccaacaggccccaucguuagagguguaaccauggucauagacaagcuauccggcaucccgauucgcggagggauagcaaagaacgacucgauggucagggucgacgucuucaccaaggcagggaaauuccaccugguacccguauacguccaucacgcgguagcaaaagugcuacccaaccgcgcaguagucgcuuacaaagacgaaacagaauggacccucaucgacgacggauucgauuucuguuucucaauguaccccaacgaccuacugcgcaucaaacugcgaaacgcaucccaucugggguacuaugcuagcugcaaccgaucaacgggugcaauaaaucucuggagccacgaccgcaaccaacaagucggaaaagacggcaugaucgaaaguaucggcgucaaaaccgcccuaaacguagaaaaacucaacaucgacguccuaggaaauagauacccagcaccaccagagaaaaggcgagaccuggcauga

SEQ ID NO: 7445 - RNA, 3384 nt, Artificial Sequence
  Cas9 variant
augagcgaccuggugcucggccuggacaucgggaucggcuccguaggugugggcauccugaacaaggugacaggagagauuauccacaagaacagccgcaucuuccccgccgcccaggcggagaacaacgucgagcggcgcaucaaccggcaaggccgccggcucacccgccggaagaagcaccgccgggugagacucaaccaccuguucgaggaguccggccucaucacggacuuuaccaacgugagcaucaaccugaaccccuaccagcugcgugucaaggggcucaccgacgagcuguccaacgaggagcuguucaucgcccucaagaauaugguaaagcaccgcggcaucagcuaccuggacgacgccuccgacgacgggaacagcuccgugggggacuaugcccagaucgucaaggagaacagcaagcagcuggagaccaagacgcccgggcagauccaacuagagcgguaucaaaaguacggacagcuccgcggcgauuucaccguggaggaggacgggaagaaacaccgccugaucaacguguuccccaccuccgccuaccgagcggaggcccuccggauccugcagacccagcaggaguucaacccccagaucacggacgaguucauuaacagcuaccugcagauucuaaccggcaagcgcaaguacuaccacgggccggguaacgagaagucccggaccgacuacggccgcuacaccacgaagaaggacagcgaggacgaguacaucacccuggacaacaucuucgggauccugauaggcaagugcaccuucuaccccgaggaauaccgggccgccaaggcguccuacaccgcccaggaguucaaccuccugaacgaccugaacaacuugacugucccgaccgagacaaagaagcugagcgaggaacagaagaaccagaucauuaccaacgugaagaacgagaaggccauggggcccgccaagcuguucaaguacaucgccaaacuccugaguugugacguggcggacaucaagggcuaccgcaucgacaagagcgacaaggccgagauccacacguucgaggccuaccguaagaugaagacccuggccacaaucgacaucgagcaaauggagcgggagaaccucgacaagcuggccuacguccugacccucaauacggagaaggaggggauacaggaggcgcuggagcacgaguucgcugacggcaccuucucccaggagcagaucgacgaguuagugcaguuccgcaaggccaacagcagcauuuucggcaagggguggcacuccuucagcguuaagcucaugauggagcugaucccggagcuguacgcaaccuccgaggagcagaugaccauccucacgcggcugggcaagcagaagacaaccagcuccagcaacaagaccaaguacaucgacgagaagcagcugacggaggagauauacaaccccgucgccgcgaaaucggugcgccaggccaucaagaucgugaacgccgccaucaaggaguacggggacuucgacaacaucgucaucgagauggcccgggagaccaacgaggacgaugaaaagaaggcgauccagaagauccagaaggccaacaaggacgaaaaggacgccgccaugcucaaagcggcaaaccaguacaacgguaaggccgagcugccccacagcguguuccacgggcacaagcaguuagccaccaaaauccgccucuggcaccagcagggcgagcggugccuguauaccggcaagacgaucuccauccacgaccugaucaacaacucaaaucaguucgagaucgaccauauccugccccucuccaucaccuucgacgacagccuggccaauaagguguuggucuacgcgacagccaaccaggagaaggggcagcgcaccccguaccaggcacucgacuccauggacgacgccuggagcuuccgggaguuaaaggccuucguccgcgacuccaaggcgcugagcaacaagaagaaagaauaccuccugaccgaggaggacauuuccaaguucgauguccggaagaaguucaucgagcgcaaccugguggacacgcgguaugccagccgcgugguccucaacgcccuccaggagcacuuccgggugcacaagaccgacacuaagguguccgucgugcgaggccaguucaccagccagcugcggagacacugggggaucgagaagacgcgggacaccuaccaccaccacgccguggacgcccucaucauugcggccagcucccagcuaaaccuguggaagaagcagaagaacacccucgucagcuacuccgaggaccaacugcuggacaucgagaccggcgaacucaucagcgacgacgaguacaaggaguccguguucaaggcccccuaccagcacuucguggacacguuaaagagcaaggaguucgaggacuccauccuguucagcuaccaggucgauuccaaguucaaccgcaaaaucagcgacgccaccaucuacgcgacccgccaggccaagguggggaaagacaagaaggacgagaccuaugugcucggcaagaucaaggacaucuacucccagacgggcuacgacgccuuuaucaagaucuacaagaaggacaagucuaaguucuugauguaucggcacgacccccagaccuucgagaaggucaucgagccuauccuggagaacuacccgaacaaggagcucaacgagaaggggaaggaggugcccugcaaccccuuccugaaguacaaggaagaccacggcuacauccgcaaguacuccaagaaggggaacggccccgagaucaagagccugaaguacuacgacuccaagcucggcaaucacaucgacaucaccccaaagaauaguaacaacaagguaguccugcagagcgugucucccuggcgggccgacguguauuucaacaagaccacggggaaauacgagauccugggccucaaguacgccgaccugaaguucgagaaggggacaggcaccuacaagaucagcgaggagaaguacaacgacaucaagaucaaggagggggucgacucagauagcgaguucaaguucacccuguacaagaacgaccuccugcugaucaaggacacggagaccaaggagcagcagcuauuccgcuuucugucccgaaccaugcccaacguuaaacacuacguggagcugaagccguacgacaagcagaaauucgaugacaacgaggagcucaucaagauccugggcaucgucgcgaaaggagggcagugcaagaagggcgugagcaagccgaacaucuccaucuacaaaauccgcaccgaugugcuggggaaccagcacaucauuaagaacgagggcgacaagcccaagcucgacuucuga

SEQ ID NO: 7446 - RNA, 3384 nt, Artificial Sequence
  Cas9 variant
augaacggucuggugcucggguuagacaucgguaucgccagcguuggggugggcauccuggagaaggacuccgggaagaucauccacgccaacagccgcaucuuccccgcggccaccgcggacaacaacguggagagacgcaccucccgccaggcccgccggcucaaccgcagaaagaagcaccgcagcguccgucugcacgaccuguucgaggaguacggccuacugacggacuucuccaagguguccaucaaccugaacccguaccagauccgcgugcagggccuagacaaacggcugaccaacgaggaguuguucaucgcccucaagaacaucgucaagcgccgggggaucuccuaccuggacgacgcgucagaggacggcggggccguuuccagcgacuacggcaaggccguggaggagaaccgcaagcuacucgcccaacagacccccgggcaaauccagcuggaccgguucgagaaguacggccaaguccgcggcgacuucaccgugguggaaaacggagagaagcggcgccugaucaacgucuucuccacgagugcguaccggaaggaggccgagcggauccuccggaagcagcaggaguucaacaacaagauuaccgaggguuucaucgaggacuaccugaccaucuugaccgggaagcgcaaguauuaccacggccccggcaacgaaaagagccgcacggacuacggacguuacaccaccaagaaggacucucagggcgaguacaucacccucgauaacaucuuugggauccugaucggcaagugcacguucuacccugacgaguaucgcgccuccaaagccagcuacaccgcccaggaguucaaccuguugaacgaccugaacaaccugaccgugccgaccgagacgaagaagcucuccguugagcagaagaagacgaucgucgaguacgcgaagaccgccaagacccugggggccaguacgcugcucaaguacauugccaagcugaucggcguguccguggaccagauccacggcuaccggaucgaccccaaugaaaagcccgagaugcacaccuucgaggucuaccgcaagaugcagucucuggagacaauacggguggaggagcucccccgcaaggucaucgacgagcuggcccacauccuaacccucaacacggagcgggaagggaucgaggaggcgaucaaugccaagcugaaggacaucuucagccaggaccagguccuggagcucgugcaguucagaaagaacaauagcagccuguucuccaaagguuggcacaacuucagccugaagcucaugauggagcucaucccagagcucuacgagaccuccgaggaacagaugaccauucucacccggcuugggaagcagaaguccaaggagacgagcaaacgcaccaaguacaucgacgagaaggagcugaccgaggagaucuacaaccccguggucgccaagagcgugcggcaagccaucaagaucaucaacgaggccaccaagcgcuacggaaucuucgacaacaucgucaucgagauggcgcgggagaacaacgaagaggacgccaagaaggaguacaucaagcgccagaaggccaaccucgacgagaagaacgccgcgauggagaaagccgccuuccaguacaacgggaagaaggagcugccggauaacguguuccacgggcacaaggagcuugccacgaagauccggcuguggcaccaacaaggcgagaagugccucuacaccgguaagaacauacccaucuccgaccugauucagaaccgcuacaaguacgagauagaccacauccugccgcucagccuguccuucgacgacagccuguccaacaaggugcucguccuggccaccgcgaaccaggagaaaggccagcggacccccuuccaggcccuggacagcauggacuacgccugguccuacagagaguucaagucauaugugaaggacuccaagcuccugagcaacaagaagaaggacuaccugcucacggaggaggacaucuccaagaucgaggugaagcagaaguuuaucgagaggaaccuggucgacacccgcuacagcagccgcguggugcugaacgcccuccaggacuucuacaaggagcaccaguucgacaccaccaucagcgucgugcgggggcaauucaccagucagcugcgccggaaguggggcaucgagaagucccgcgagacguaccaucaccacgccguggacgcgcugaucauugccgccagcagucagcuccggcuguggaagaagcauaacaacccccugaucagcuacaaggaggagcaguucguagacuccgagaccggggagaucauuaguauguccgacgacgaguacaaagagcucguguucaaggcccccuacgaccacuucguggacacccucaagagcaagaaguucgaggacaguauccuauucagcuaccaggucgauuccaaguacaaccgcaagaucagcgacgccaccaucuacgcgacgcggaaggccaagcuggacaaggacaaguccgaggagaccuacgugcugggcaagaucaaggacaucuacagccaggccggauacgacaccuucaucaagaucuacaacaaggacaagucccgcuuccugauguaccacaaggacccgcagaccuucgagaagguaaucgaggagauccuccggacguaccccagcaaggagcugaacgagaagaacaaggagguccccugcaacccauucgagaaguaccgccaggagaacgggccgauccggaaguauagccgcaagggaaacgggcccgagaucaagucccugaaguacuacgacaacaagcugggcaaccacauugauaucaccccuaacgagagcaugaaccaggucgugcugcagucccugaagcccuggagaacagacguuuucuucaaccaccagaccgagaaguacgagcucaugggccugaaguacagcgaccugaacuucgagaagggguccgggaaguacucgauaagucucgagaaguacaacagcaucaagaugaaugaggggguguccgaggagagcgaguucaaguucacgcuguacaagaacgacuugauccucaucaaggacgcgcugacaaaggaggcccaaaucuuccgcuacggcucccgaaacgacaccagcaagcacuacguggagcugaagccguacgacauguccaaguucgagggagacgagcgccuaauuaaggugcugggcaccguggcgaagggcgggcgguguaucaaggggcugaacaagaaggacaucagcaucuucaaggugaagacggacgucuuagggaacaagcacuucaucaagaaggagggcgaggagcccaagcugaaguucuga

SEQ ID NO: 7447 - RNA, 3387 nt, Artificial Sequence
  Cas9 variant
augaccaaacuaggcaaaccauacggcaucggggucgacaucggauccaacagcaucggguucgcugccguagacgaaaacagccaucucauccgacucaaaggcaaaacggucaucggcgcccgacucuucgaagaaggcaaagccgcggcgaaacgcagggcuggccgaaccaccagacgaagauuaucacgcaaccgauggcgccucuccuuucuucgagacuucuucgaaucacacaucacaccaaccgaccccaacuucuucaugaggcagaaguacuccgagaucucccccaaagacaaggcccgauauaaguacgaaaaacgccucuucaacgaccgcaccgacgcugaguucuaucaacaguacucaacgauguaccaccuccggaaccggcuaaugaccgacccaucacgagcagacguccgcgaaaucuacuucgccauacaccacauccuaaaaucucgcggccauuuccuuacacccggagacgccaaagacuucaacacaaaugacguggcccuggaugaaauauucccagcccuacaagacgccuacgcccaagucuacccagaccuugguauaaccuuugacgaagauaaagccaacgaguuuaaaacgauacugcuaaacgaaaucgcaaccagcaucgacacccagcgcgcacucguaaaacuccuccuagccgaggaagacgacaaagacauacucaaacaacaaaaacaaguuuugacagaauuugccaaagccgucgucggacuuaaaacuaagcucaaccucgcacuaggaaccgagguugacuccucagaagccacagcauggaacuucucacuaggacagcuagacgacaaaugggccgggaucgagucagcgaugacggaugagggcacagaaauccuggaccaaauaagagaccuauaccgggccagacuucuaaacggcauaguuccaacaggaaagacccucucacaagcuaaagucgaugacuacacacaacaccacgaagaucugcaacucuucaaagcguaucucaaacaacuagaagacgacgguaccgcaaaagccauccggcaacucuacgacagauacaucgacggcgacgaugcagcgcccuuccucagagaaaacuucgucaaagcccuaaccaaagacgucaccgcgcacccaaacaccaaguccccagagcuauuagaaagacucgcacagcccgauuucaugcuaaaacaaagaaacaaagcaaacggugcaauucccguucaaaugcaacaacgggagcucgaccaaaucaucaaaaaccaagcagucuacuacgacuggcuagcggcaccaaacccggucgagaagcacaggaaguccaugcccuaccaacuagacgagcucuugaacuuccggauacccuauuauguaggaccccuagugacagccaaagaacaaaaggccgcccaaggaggagucuuugcguggaugguccguaaagacccagaaggaaacauaaccccauacaacuucgacgaaaaagucgacagggaggcaagcgccaacaccuucauucaacgcaugaagacaacugacacguaccuaauaggcgaggacguccuccccaaacaaucgcugcuauaccagcgauacgaggugcucaaugagcucaacaauguacgaguaaacaacgagaagcuaucaaucgaacaaaaacaacaaguaauccgcgaacuuuucgagcgccacaauucaguuacaauaaaacaauucgcagaaaaccugcgcgcacacggagacuaugcacacaucccggaaaucagaggucuagcagacgaaaaacgcuuccuauccucccuaucgaccuaccgacaacuuaaaucucuacugcccgaagcaaucgacgaccccgcuaagcaagcagacaucgaaaacaucauagcguggagcaccguauucgaagacgcagccaucuucaagaccaaacugaaggagaucucauggcuaggaucagaagccauaaccaaacuaucgaacauucgauaccguggguggggccaauucagccgaaaguuucucaacggauuaacccugggcaacggacacaccaucauccaagaacuccugcucaguacaaacaacuugaugcagauacuaaccgacgagacacuccaaaagaaaaugaccgaauugaacgccgacaaacucaaaacagcgaacaucaacgacgcgauagacaacgccuauaccucaccaagcaacaagaaagcccucagacaaguacucagagucguagacgacaucaaacgcgccgcagacggccaagaucccuccuggcucuaugucgaaacagccgacggcggagggaccccgggaaaacgcacgcgugccaggcaacaccaacuacaagaaauauacgccaacgccgcacacgaacugauagacaccgccguaagaggcgaacuagaagacaaaauaagugauaaagccgacuuuaacgaccggcucguccuauacuucaugcaaggaggcagagauauauacaccggcgccccgcuaaacaucgaccaacuauccucauacgacaucgaccacauccucccccaaucgcucaucaaagacaacucacuugacaaccgcguccuaguacacgcuauaaucaaccgcgaaaagaacgccacauucgccucgacaauauacgcccaaaagaugaacgcuacuuggaggcaauggcacgaggccggacugaucuccggcagaaaacuccgcaaccugcaaaugcgcccugaccaaaucgauaaauaugccucuggcuuugucgcccgccagcuaguugagacacgacaaauaauaaagcucaccgaacaaauagucgccgcucaauaccccgacacgaaaauaaucgcagucaaagccggcuuaagccaccaacuuagagaagaacucgaauuucccaaaaacagagacgucaaccacuaccaccacgccuucgacgccuuccuagcagcgcgcauagguacauaccuccucaaacgcuucccaaaccuccaagccuucuucacauacgggaaauucaccaaagccgaugugaagaaacucagaggguucaauuucaucagggauauaacccacgcagaagacaaaaucgucgccaaagauacaggagaaguggucugggacaaacaaagggacguagacgaacuagaccgcaucuacaacuucaaaagaaugcucaucacccacgagguaagauucgaaacagccgaccuguucaaacaaaccguguauggugcccgcgacuccaaagaagccggcggaucgaaacaacuuauccccaagaagaaagacauccaauugaucuucaugggcgcaauuuccgagcgcacacgaccgauucugccccuguga

SEQ ID NO: 7448 - RNA, 3387 nt, Artificial Sequence
  Cas9 variant
auggacgagaaaauggacuaucgaaucggccucgacauaggaaucgcgagcguaggcugggcaguacuacaaaacaacagcgacgacgagcccguccgaauaguggaccucgggguaagaauauucgacacagcagagauaccaaagacaggagaaucccucgcagguccgaggcgcgccgcacgaacuacgagacgccgacuacgcaggcgaaagcaccgacuagaccguauaaaauggcuauucgaaaaucaaggucuaauaaauaucgacgacuuccuaaagcgguauaacauggcaggccucccagacgucuaccaauugcgauacgaagcacucgaucggaagcucaccgacgaagaacuugcccagguacuacuacacauagcgaaacacagaggcuuucgcucaaccaggaaggccgaaacagccgccaaggaaaacggagccguacuaaaggcgacagaugagaaccaaaaacgcaugcaagaaaaaggauacagaaccguaggcgaaaugauauaccucgacgaagcauucaggaucggcugcucauggagcgaaaagggauacauacucacgccccggaacaaagcagaaaacuaucaacacacaaugcuccgggcgaugcucgucgaagaaguaaaagaaaucuucagcagucagagacggcucgggaacaaaaaggccaccgaagaacuagaagaaaaauaucuagaaaucaugaccagccaacgauccuucgaccucggcccaggcaugcaaccagacgggaaaccauccccguacgcaauggaaggcuuuagcgaccggguaggaaaaugcaccuuccucggcgaccaaggagaacuccgaggagcaaaaggcaccuacacagcggaauacuucguagccuuacagaaaaucaaccacaccaagcucguuaaccaagacggcgaaacaagaaacuucacggaggaagaacggcgagcccucacucugcuacuguucacacagaaagaagucaaguacgcagccgugagaaagaaacuaggccugcccgaagauauccuguucuacaaccuaaauuacaagaaagccgccacaaaagaagaacagcaaaaagagaaccagaacacugagaaagccaaauucaucggaaugccguacuaucacgauuacaagaaaugccuggaggaacgggucaaauaccuaacggagaacgaagucagggaucuguucgacgaaaucggaaugauccuaacaugcuacaaaaacgacgacucacguaccgaacgccucgccaagcugggacuggucccaaucgagauggagggguuacuagcauauacgccaaccaaauuccaacaccuguccaugaaggccaugcgaaacauaaucccguuccucgagaaagggaugacguacgacaaagccugcgaagaagccggcuaugacuucaaagcagacucaaaaggcacgaaacagaaacuccuuacgggugaaaacgucaaccagacgauaaacgaaaucacgaacccagucguaaagcgcucgguaagccaaacagucaaggucaucaacgcgaucauacgaacauacggaucuccacaagcaauaaauauagagcucgcgcgagaaaugucaaaaacauucgaggaacgacgcaagauaaaaggagacauggaaaagagacagaaaaacaacgaggacgucaaaaagcagauacaggaacuaggcaaacucaguccaaccgggcaagacauacugaaauaccgguuauggcaagagcaacaaggcaucugcauguacucagguaaaacaauaccccucgaagaacucuucaaacccggcuacgacauagaccacauacuaccguauagcauaacguucgacgacagcuuccgcaacaaaguccuaguaacgagccaggaaaacaggcaaaaaggcaacagaacacccuacgaguacaugggaaacgacgaacaaagauggaacgaguucgaaacuagggugaaaacuacgauucgggacuacaagaaacaacaaaaacuccuaaagaaacacuuuagcgaagaggaacggucagaauuuaaagaacgcaaccuuaccgacacaaaauacaucaccacagucaucuauaacaugauaagacaaaaccuagaaauggcaccacugaaccggcccgagaaaaagaaacaagugcgagcugucaacggagccauaaccgcauaccuacgcaaacgguggggacuaccacaaaagaaccgggaaacggauacgcaccaugcgauggacgcaguagugauagcgugcugcacagacggcaugauccagaaaauuagcagguacacgaaagucagggagcgaugcuacucuaagggcacagaguucgucgacgcugaaacaggcgaaaucuuccgcccggaagauuacagccgggccgagugggacgagaucuucggaguacacauaccuaaaccgugggagacauuccgugcagaacuagacgucaggaugggcgacgaccccaaaggguuccuagauacacacagcgacgucgcacucgagcuagacuacccggaauacaucuacgaaaaccuacgcccuauuuucgucagccgcaugccgaaccauaaaguuaccggggcggcacacgcagauaccauccggagcccgcgacacuucaaagacgagggaauaguucucaccaaaaccgcccuaacggaccuaaaacucgacaaagacggcgagauagauggguacuacaauccucaaagcgaucuacuccuguacgaagcacuaaagaaacaacugcuccuauacggcaacgaugcuaagaaagcauucgcgcaagacuuccauaaacccaaagccgacggcaccgaaggaccaguaguacgcaaagugaaaauacagaaaaagcaaaccaugggggucuucgucgacagugguaacgggauagcggaaaacggcggcauggugagaauugacguguucagggucaacgggaaauacuacuucguacccguauauacagcagaugucguaaagaaagucuuacccaaccgagccuccaccgccaacaaaccguacucggaauggcggacgauggaagacaaagacuuccucuucucacuauacucaagagaucugguacacauaaaaaguaaaaagggaauccccaucaagaacguagacggcagccuaggcgaaucaaaggaaguauaugcguacuacaucggcgccgacaucagcggagcaaaaaucgaaggcaaagcacacgacagucgguacacuuuccgaggcaucggaguacaaaaacucgaacuaaucgaaaaaugccagguagacauccucggccacaucaguaccgugaaaaacgagaaacgaaugggcuucuccuga

SEQ ID NO: 7449 - RNA, 3387 nt, Artificial Sequence
  Cas9 variant
augaacgacaaaaaccaaaaauaccgccuuggccucgaucuaggaaccaacuccaucggauggugcaucuacucccucgacgucaauaacaaaccagaaacucucaucgacauggguguaaggauauucagcgacggcagagacccaaaaaccaaggaaccccucgccgucgaacgccgcacugcccggggccuccgcagaauauuacacagacggaaacuccgcagaagacaaauguuccgacuacuccaagagcaagggcuuaugcccaacgacgccagcgaagccgcggcccucaaaucacuaaaccccuacgaauuacgaguaaaagcgcucgacacgaaacuagaacccuacgaacugggccgagcccuguucaaccucucaguacgacgcggguucaagucgaaccgcaaagaggccguccaagagaaagaaaaagacucucaaaaugacgccaagucccaaaacgaaaaaugcgaacaccuagccaaggccauaaaagacagcgggugccguacccuaggcgaguucuuguggaaacacaagaacacagaaacacagcaaaccgaaaacgacgcacgcaacauaggcaugcgauuuguaccaggcagaucgaacuacuacccgacaagaagaauguacguugaagaguucgaugcgauucgcaaggcccaagaacccuauuacagcggcgucaacugggacgccuuacacgagaaacucuucuaccaaaggccacuaagagcacaggaacgcggaaaguguagauacaugcccgacaaagaacgaacuuucaaagccaugcccugcucccagaagauacgcauacugcaagaggucuacaacauggacuacaucgaugaauacggcaagacaaucccgcuagaagaagcccaaaccgacucacugaucagccuacuagacaagagagaaaaacuauccuucaaagccaugaagaaagaacuaggcauugacgaaagcugcacuuucaaccucgaacgcggagguagggaauaccugcaaggcaacgccgccgcgguaaaacuacgaaacaagaaacgauucggagagcucugggacucccucucgcuggcuaaacaggacgcaauagucgaaaaacuaauaacggccgacgaagacgccgaaauuaucuccaugcuugcacaguacaacuugacugacgagcaaaagaaaaacauagcagucacaguauuaccaucaggaaccgcgaugcucugcaaagaaguaaccgagaugcuaguccagaaaauggagcaaaauaaaauuccacucaccgucgcagugcaaaugcucggauacacauacgcagaccaaagcgucagggaagaagauacacucccauauuacggcgccauucucaccggauccaccaugggagcgcaccccgaagcagacgaauccgaacccgaguuaaaauacgggaaaauuuccaacccaaccguccacguagcgcuaaaccaaacacguacggucgugaaugcccugauaaaggcuuacgggaaaccgcaacaaaucgucgucgaacucagucgcgaccuuaaagccucaagagaagccaaggcucgaauccagaaaacuaucacaaugaaucagaaaaggaacgaaagagacaacaagaacaucaccgacaucaccaaaauccccuaucccaacagaaacgaccgacuaaaauacagacuaugggaagaacuaggaucaggaaguaacagcuucucccggaaaugccucuacugcggcaaaccaauaucugggagcgagaucuucacugaaaacauagaaauagaacacauacuacccuucgggaggacucucuucgacggggaaacaaacaagacaguagcacauaccgacugcaaccgcgacaagggcgaccgcucaccauucgaagccuucggcagcagccccaacggcuacaacuggcacgaaauaugcgcccgggccaacagccugaaaaacccggcaaaacgcacacuauucgcagagaacgcaauggaaaaguucgaaaaagacaauagcuucauacaacgucaacucaccgacaacgcauaccuaucacggucagcacugagauaccuucgaugcauaugcaaagauguguggagcauaaacggcggcaugacuaaacuauugcgagacaaauggaacauagacagcauacuaaagagaaaaaucgacgaccccgaaaucgcccacuucgaacucaaaaacgaccaaaucggucaauacaagaaaaaccgcuacgaccaccgacaccacgcccucgacgccagcgucauagcccucaucgacagagcaaugguccaagaaauuagucaacuaaauaaaauccgccucaaaaaccgaauagaagcaccucaaaugccggugcuacgcucagaacuuaucgaaaaggucaaacacauaaccgucaguuucaaacccgaucauggcagacaaggcaaacugucaaaagaaacgcuacucggaaaaauaaagaaaauagagaaaguagacauugacucaauucaaaccgacgacauugcaucgauaaaggacgacgcaauacguacacgcuucgaaacaaaaagacgagaacuaggagacauaaccaaagccaaggccgcacucaaaaccgaguucccgaaacuggacgucuucaagaccuacuauguauccagaacacccaucguaucacucacagaaaagaauauuaauagcaucguagacgagaagaucaaagaaaaacuaaaaacguucauaaaagaacacgccgaccuaucauucgcggaacaacugcaaaaauucagcgaaaccgaauggauagggaagccgucagcagcaggcaaaccaggcaagaaauaccggauagaaaaagugcgcuguauaaacugggggcaaacgcccauaacaaucaccucgagcgcuguccccagauaccucugccccgaagacuaccucgcagcgguagucuggcaaaucccaagcaaaaagaaagacaccgagccugaauacaaagcgaccuuccuacgcagagacgaguucgacguuaacaacaaacccaaaaagcucgaaaaaccacacgacgcggcccaauacaucugcaugcucuacaaagacgacuaccuggaguucacagaauccggcgccacgcaccucugccgcauagcaggccuaccggccagccaaaauaacaaaauagacauccgcccgaucuaugcaguauccgacugcaaagacuggaucaucgcaacaaacgaaaacaugcuagaacccugcuggaaaccccaaaaagaagaaaagcguaucuccguaaacguccucuucgggaaacauaaagcccgaucggucacaguaaacccaaucggacgcgucuuuagaaaguga

SEQ ID NO: 7450 - RNA, 3387 nt, Artificial Sequence
  Cas9 variant
augagcgaccuggugcucggccuggacaucgggaucggcuccgucggggugggcauccugaauaaagugaccggggagaucauccacaagaacagccgcaucuuccccgcggcccaggcggaaaacaacgucgagcggcgcaccaaucggcagggccgccggcugacgcgucggaagaagcaccgccgcgugcgccugaaccaccuguucgaggaguccggucucaucaccgacuucaccaaggugagcaucaaccugaacccguaccagcugcgggucaaggggcucaucgacgagcuguccaacgaagaacuauucaucgcccucaagaacauggugaagcaccgcgguaucagcuaccuggacgacgccucggacgacgggaacagcuccgugggcgacuacgcccagaucgucaaggagaacuccaagcagcuggagaccaagacgccagggcagauccagcuagagcgguaccagaaguacggccaacugcgcggcgacuucaccguggaggaggaugggaagaagcaccggcugaucaacguguuccccaccuccgcguaccgaucugaggcguugcggauacugcagacacagaaggaguucaacccccagauaacggacgaguucaucaaccgcuacuuagagauccucaccggcaagcggaaauacuaccacgggccgggcaacgagaagucccgcaccgacuacggccgguacaccacgaagaaggacagcgagaacgaauacaucaccuuggacaacauuuucgggauacugaucggcaagugcaccuucuaucccgaggaguaccgcgccgcaaaggccuccuacaccgcgcaggaguuuaaccuccuaaacgaccugaacaaccucacgguccccaccgagaccaagaaacugagcgaggaacagaagaaccagaucaucaacuacgugaagaacgagaaggccauggggccggccaaacuguucaaguacaucgccaagcuccuguccugcgacguggccgacaucaagggcuaccgcaucgacaagagcgacaaggcggagauccacaccuucgaggcauaccggaagaugaagacguuagagaccaucgacuucgagaaaaugucccgcgaucagcucgacaagcuggccuacguccugacccucaacaccgagcgggaggggauccaggaggcccuggaucacgaguucgccgacggcaacuucagccaggagcagaucgacgagcuggugcaguuccgcaaggcgaacagcuccaucuucgguaagggguggcacaacuucagcgugaagcucaugauggagcucaucccggagcuguacgccacguccgaggagcagaugaccaucuugacccggcugggcaagcagaagaccacgagcuccuccaacaagaccaaguacauugacgaaaagcuacucaccgaggagaucuauaaccccguaguggccaaguccgugcgccaggccauaaagauagucaacgccgcgaucaaggaguacggggacuucgacaacaucgugaucgagauggcccgggaaaccaacgaggacgacgagaagaaggcuauccagaagauccagaaggccaacaaggaugagaaggacgccgccaugcugaaggccgccaaccaguauaacggccgcgccgagcugccccacagcguguuccacgggcacaagcagcucgcgacgaagauccggcuguggcaccagcaaggcgagcgcugccuguauaccggcaagaccaucuccauccacgaccugaucaacaaccccaaucaguucgagaucgaccacauccucccgcugucgaucaccuucgacgacucccuggccaacaagguccucguguacgccacggcgaaccaggagaaagggcagcguaccccuuaccaggcccuggacagcauggaugacgcgugguccuuccgcgagcugaaggccuucguccgggagagcaagucccucagcaacaagaagaaggaguaccuucugaccgaagaggacaucucccgcuucgacgugcggaagaaguucaucgagcgcaaccucguggacacccgguacgccagcagggucguccugaaugcccugcaggagcacuuccgggcccacaagaccgacacaaaaguguccgucguucgcggccaguucaccagccagcuccgccggcacugggggauugagaagacccgcgacaccuaccaccaccaugcggucgacgcucugaucaucgccgccagcucccaguugaaucucuggaagaagcagaagaacacgcuggucaauuacagcgagaaccagcugcucgacaucgaaaccggcgagcugaucuccgacgacgaguacaaggagagcguguucaaggcccccuaccagcacuucguggacacccucaagagcaaggaguucgaagacagcauccuguucuccuaccaggucgacagcaaguucaaccggaagaucuccgacgcgaccaucuacgccacacgccaggccaagguggggaaggacaagaaggacgagaccuacgugcugggcaagaucaaggacaucuacagccagaccgguuacgacgccuucaucaaaaucuaccagaaggacaaguccaaguucuuaauguaccggcacgacccucaaaccuucgagaaggucaucgaaccgauccucgagaacuaccccaacaaagagaugaaugagaaggggaaggaggugccuugcaaccccuuccugaaguacaaggaggaacacggcgacuacauccgcaaguacagcaagaaggggaacggcccggagaucaagagucugaaguacuacgacagcaagcucggcaaccacaucgacaucacgcccaaggacuccaacaacaaggugguccugcagagcgugucacccuggcgggcggacguguacuucaacaagaccaccgggaaguacgagauccugggccucaaguacgccgaccuucaguucgagaaggggacaggcacguacaagaucagccaggagaaguacaacgucaucaagaagaaggaggggguggacagcgacuccgaguucaaguucacccuguacaagaacgaccuccugcugaucaaggacaccgaaaccaaggagcagcagcuguuccgcuuccucagccggacgaagcccaaugugaagcacuacguugagcugaagccguacgacaagcagaaguucgagggcaacgagucccucaucaaugugcugggcgccguggccaagggcgggcagugccagaaggggaucaacaagcccaacaucagcaucuacaagguccguaccgacgugcugggcaaccagcacaucaucaagaaugagggggacaagccaaagcucgacuucuga

SEQ ID NO: 7451 - RNA, 3387 nt, Artificial Sequence
  Cas9 variant
auggacgagaaaauggacuaccgaaucggccuggauaucggcauagcaaguguugggugggccguucuacaaaauaacagcgacgacgaacccgugcgcauaguggaccucggcguccggauauucgacaccgcagaaaucccuaaaacaggcgaaagccuagccggcccgagacgagcagcacgaacaacccgccgacgacuacgccgccgaaagcacaggcuggaccgaaucaaauggcuguucgaaaaucaaggcuuaaucaacaucgacgacuuucucaagcgguacaacauggccggacuacccgacguguaucagcugcgauacgaagcgcucgacagaaaacucacagacgaagaacuagcccagguccucuuacacaucgcaaaacaccgcggauuccggagcacccggaaggcagaaaccgcagcgaaagagaacggagcgguccuaaaagcaaccgacgaaaaccagaagagaaugcaggagaaaggguaucgaacuguaggagaaaugaucuaccucgacgaagccuuccgaacagggugcagcuggagcgaaaagggauacauucugacaccaagaaacaaggcagagaacuaccagcauaccaugcucagggcuaugcucguggaagaaguaaaagagauauuuagcagccagcgcaggcuaggaaacgagaaagccacggaggagcucgaggagaaauaucucgaaauaaugaccagccagcggagcuuugaccuaggacccggcaugcaaccagauggaaagcccagcccauacgcgauggaaggcuucagcgaccgcguagggaaaugcaccuuccuaggcgaccaaggcgaauuacgaggggccaagggaaccuacacagccgaauacuuuguugcacuucagaaaauaaaccacaccaaguuggucaaccaagauggcgagacgcgcaacuucacggaagaggaacgacgcgcacuaacacuacuacuauuuacgcaaaaggaggucaaauacgcagcaguacggaagaaacucgggcugccagaagauauacuauucuacaaccucaacuacaagaaagcagcaacaaaagaagaacaacaaaaagaaaaccaaaacaccgaaaaggccaaauucaucggaaugccauacuaccacgacuacaaaaagugccucgaagaaagggucaaauaccuaaccgaaaacgaaguccgcgaccucuucgacgaaaucggcacaauacugacguguuacaaaaacgacgacuccagaacagaacgacuugccaaacuaggauuagugcccauagaaauggagggccuacuagccuacacccccacaaaauuccaacaccuaagcaugaaagcgaugagaaacaucauccccuuucuggaaaagggcaugacguacgacaaagcgugcgaagaagccggauacgacuuuaaagccgacagcaagggcauaaaacaaaagcugcuuaccggagagaaagucaaccaaaccauaaacgaaaucacuaacccaguaguaaaacgcagcguaagccagaccguaaagguuauaaacgcgauaauaagaacauacggcagcccacaagcgauaaacaucgaguuagcacgcgagaugucgaaaacuuucgaagaacgacgcaaaaucaagggcgacauggagaaaagacagaaaaacaacgaagacgugaagaaacaaauccaagaacuaggcaaacuaagcccaacaggucaagacauucucaaauaccgacuauggcaagaacaacaaggaaucugcauguacagcggaaaaacgaucccccuggaggaacucuucaagccaggcuacgacaucgaccacauccuacccuacucaaucaccuucgacgacagcuuccgaaacaaggugcugguaacaagccaagaaaaccgacaaaaagggaaccggaccccguacgaguacaugggaaacgacgaacagcgauggaaugaguucgaaacacgagugaagacaacaaucagagacuacaaaaagcaacaaaaacucuuaaagaagcacuucuccgaggaagaacgcuccgaguucaaagaacggaaccugaccgacacaaaauacauaaccaccgucauauacaacaugauccgucaaaaucuagaaauggcaccacucaaccgucccgagaaaaagaaacaggugcgagccgucaacggagccaucacggcauaccuacgaaaacgcugggggcucccgcagaaaaacagagaaacggacacccaccacgccauggacgcgguugucaucgcaugcugcaccgauggaaugauacagaaaaucagccgcuacaccaaagucagagaacgaugcuacucaaaagguaccgaauuuguagaugcagaaacgggagaaauauucagaccggaagacuauucccgagcagagugggacgagaucuucggaguccacauaccaaaacccugggaaacguuccgagcggaacucgacguacgcaugggagacgauccgaaaggcuuccuggacacacacagcgacguagcacuugaacuagacuacccggaauacaucuacgaaaaccugcguccgauuuucgucaguagaaugccaaaccacaaagugacaggagcggcacacgcagauaccauccggagcccccgacacuucaaagacgaggggauagugcucacaaaaacagcacuaacagaccucaaacuagacaaagacggagaaauagacggcuacuacaacccccaaagcgaccuccuacuauacgaagcacugaagaaacaacuccuccucuacgggaacgacgcgaagaaagccuucgcccaagauuuccacaaacccaaagcggacgggacagaaggaccaguaguaagaaaaguaaaaauccaaaagaagcaaacaaugggagucuucgucgacuccgguaacgggaucgcggaaaacggagggaugguacggauagacguguuccacguaaacgggaaguacuauuucguaccagucuacaccgcagacgucguaaagaaaguacuacccaacagagcugccaccgcacauaaaccauacggggaauggaaagucauggaggacaaagauuuccuauucucccucuacagcagagaccucauccacaucaaaagcaagaaagacauaccaauaaaaauggucaacgguggcauggaaggcaucaaagagaccuacgcauauuacauaggagcagacauaucagcggccaacauacagggaaucgcccacgacagcagguacaaauuccgaggccucggaauacaaucccuggacgugcuagagaagugucaaaucgacguacucgggcacgucagcguaguacgaagcgagaaacggaugggauucuccuga

SEQ ID NO: 7452 - RNA, 3387 nt, Artificial Sequence
  Cas9 variant
augagcgaccuggugcucggccuggacaucgggaucggcuccgucggggugggcauccugaacaaagugaccggggagaucguccacaagaacgcccgcaucuuccccgccgcgcaggccgagaacaacguggagcggcgcaccaaccggcagggccgccggcucacgcgccggaagaaacaccgccgggugcgccugaaccacaucuucgaggagagcggccugaucaccgauuucaccaaggucuccaucaaccucaacccguaccagcugcgggugaaggggcugaccgacgagcucagcaacgaggagcuguucaucgcgcugaagaacauggugaagcaccgcggcaucuccuaccucgacgacgccagcgacgaugggaacuccucggucggcgacuacgcccagaucgugaaggagaacuccaagcagcuggagacgaagacucccgggcagauccagcuggagcgguaccagaaguacggccagcucagaggugacuucaccaucgaggaggacgggaagaagcaccggcugaucaacguguuccccaccagcgcguaccgugccgaggcccugcggauccuccagacgcagcaggaguuuaacccccagaucaccgacgaguucaucaacuccuaccugcagauccugaccggcaagcgcaaguacuaccacgggccgggcaacgagaagucccggaccgacuacggccgcuacacgaccaagaaggacagcgaggacgaguacaucacccucgacaacaucuucgggauccugaucgguaagugcaccuucuaccccgaggaguaccgggccgcgaaggccagcuauacggcccaggaguucaaccugcucaacgaccugaacaaccugaccguccccaccgagaccaagaagcucuccgaggagcagaagaaccagauaaucacguacgugaagaacgagaaggccauggggcccgccaagcuguucaaguacaucgcgaagcugcucgccugcgacguggccgacaucaagggcuaccgcauagacaagucugacaagccggagauccacaccuucgaggccuaccgcaagaugaagacccuggagaccaucgacgucgagcagauggagcgggagaagcuggacaagcucgccuacgugcugacgcugaacaccgaacgcgaggggauccaggaggcgauugagcacgaguuuuccgacggcaccuucagccaggagcaggucgacgagcucgugcaguuccggaaguccaacagcagcaucuucggcaagggguggcacaacuucuccgugaagcugaugauggagcugauccccgagcucuacgccaccagcgaggagcagaugacgauccugacccgccugggcaagcagaagcggaccuccagcuccaacaagaccaaguacaucgacgagaagcgcuuaacggaggagaucuacaaccccguugucgccaagagcguucgccaggcaaucaagaucgugaacgccgcgaucaaggaguacggggacuucgacaacaucgucaucgagauggcccgcgagaugaacgaggacgacgagaagaaggccaucaagaagauccaggaggccaacaaguccgagaaggacgccgcgaugcggaaggccgccaaccaguacaacggcaaggccgagcugccccacagcguguuccacgggcacaagcagcuggcgaccaagauccgccucuggcaccagcagggcgagcggugccuguacaccggcaagaccaucuccauccacgaccugaucaacaacccgaaccaguucgagaucgaccacauccucccccugagcaucacguucgacgacucccuugccaacaagguccuggucuacgccacggccaaccaggagaaggggcagcgcaccccuuaccaggcccuggacagcauggacgacgccugguccuuccgggagcugaaggccuucgugcgcgagagcaagacccuguccaacaagaagaaggaguaccuccugaccgaggaggacaucucgaaguucgacguccggaagaaguucaucgaacgcaaccugguggacacgcgguacgccucccgcguaguccucaacgcccugcaggagcauuuccgggcccgcaagaucgacaccaaggugagcgugguccgcggccaguucaccucccagcugcggcgccacugggggaucgacaagacccgggacacguaccaccaccacgcgguggacgcccucaucaucgccgccagcagccagcugaaccuguggaagaagcagaagaacacccugguguccuacagcgaggaccagcugcuggacaucgagaccggcgagcucaucuccgacgacgaguacaaggagagcgucuucaaggcccccuaccagcacuucguggacacccugaaguccaaggaguucgaggacagcauccuguucuccuaccagguggacagcaaguucaaccgcaagaucuccgacgcgacgauauacgccacccggcaagccaagguagggaaggacaagaaagacgagaccuacgugcucggcaaaaucaaggacaucuacagccaggccggcuacgacgcguucauuaagaucuaccagaaggacaaguccaaguuccugauguaccgccacgacccgcagaccuucgagaaggugaucgagcccaucuuagagaacuaccccaacaaggagaugaacgagaaggggaaggagguccccugcaacccguuccucaaguacaaggaggagcauggcgacuacauccggaaguacagcaaaaaggggaacggccccgagaucaagucacugaaguacuacgacagcaagcugggcaaccacaucgacaucacgcccaagaacuccaacaacaagguggugcuccagagcgucucccccuggcgcgccgacguguacuucaacaagaccaccgggaaguacgaaauccugggccugaaguacgccgaccuccaauucgagaaggggaccggcacguacaagaucagccaggagaaguacaacgacaucaagaagaaggaggggguggacagcgacuccgaguucaaauucacccuguacaaaaacgaccugcuccugaucaaggauaccgagaccaaggagcagcagcuauuccgguuccucagccgcuccaugccgaacaagaagcacuacguagaacuuaagcccuacagcaaggacaaguucgagaagaacgagacgcugaucgagauccucggucccaccgacaaguccggccggugcaucaaggggcuggccaagagcaaccuguccaucuucaaggugcgcaccgacauccucggcaaccagcacaucaucaagaacgagggggacaagcccaagcuggacuucuga

SEQ ID NO: 7453 - RNA, 3387 nt, Artificial Sequence
  Cas9 variant
augaccaagauccugggccucgaccuggggaccaacagcaucggcugggccguggucgacgagaagaaggagaagauccugggaaugggcucccguaucuuccccgaggggguggugaacaucggcgagggcgaggggcgggagacuucuaagaacgccucccgcaccgacgcgcggggcacccgccggcaguucuuccgccggcgccuucggaagcgcuacuuacugcgggagcucgccaagaaggggcugugcccgaucaacuacacccuggucaaggaguggaacgaggcccagaucuucaagaacaagcagcuccaggagugguucaagcugaaccccuacgagcugcgcagcaaggccauccaggagaagaucagccucgaggagcugggccggaucuucuaccacuucauccagcgccggggguuccagagcaacucccgcagcgccggcguggacaacaucgagaaguccgugauuuuuaagggcgacacgaagaccgggaagaucggcaucagcgagacccuggaguccaucaagaacaccaagacgcucgggagcuacuugcacaccaucuaccccaagcagaacaagcccuacuccggccacaaggagcggauccgcaaccgguacaccacccgccagauguacaucuacgaguucgagacuaucugggaguaccagaagcaguucuacagcgagcuguccaacgagcucaagaccguccugggcgggcggaagaaggacggcuacaaggaggacgggauccuguuccaccagcgcccgcuccgcagccaaaagcaccuggugggcuacugcuccuuugagcccaagaagaccaagugccagaucaacacaauccccuucgagcuguuccggaucuaccagugggugaauacgguggacugcaacgagaaggugaccagcgaggaccgcgggaagaugguggagcuccugcuguccaaggagaaggucagcuucaaagaaauccggaaggugauaaacaagagcgacggcuacuaccaguucaacuacaagaacgacgacaagaucgugggcuccuacaccaucagcaaccuuuccaacaagaaauucuucgggaagaagugguucgacuucagcgacaaggagcaggaagacaucuggcacguccuguccuucuucgacgaccgcgacaagcugaagcaguacgcgauaaaguacuggggcuucaaugaggagaaggccgugaagaucagcaaguucaaccucaaggagggguacuccaacuuaagccggaaggccauccacaacauccugcccuuccucaaacugggcuucauguacgacguggccgucgggcuaggcggcgugaagaacgcgcuugccgacaaguggaucgagaacgagcaguucauccuggacaacgugccguccgucgugcgcagcaacuucaagggcggguacaucgagccccugaagcagaugcucaaguacgaguucgacguguccgacaagcagcugcugaagcucuaccaccacagcuccgccaucgagaccacggaacugcugaagaagcuccccaucaacagcgaggccgacaaggagauccaguccaucaagaaccccgucgugaucaccgcgcuuuucgagauccggaaacuggucaacgagaucaucgauaccuacgggaaguuugacgagaucaagguggagcucgcgcgcgaucugaaggccucgaaguccaagcgguacgacacccgccgggaacagcugcgccuggagaaggagaacgaccggaucaagaucgagcucgagaaccugggccagcgaaucaaccacaucacgauccugaaguacaaacucugggaggagugcgacaagcggugcccguucaccgggaagaacaucgaggugaacgagcuguucaguggcgagguccagaucgagcacaucuuccccuggucccgcagccugaacgacagcuucaugaacaagacccucugcuucgccgacgagaaccgggcaaagggcaacaagacccccuacgaguucuacucugagcagggggagcagaagugggaggagaucaagauccaggcacugagcugcuucaagaacaagccaaacuacccaaacgcguaccagaaguucaagcaguucgugaagaagaagcacgacgaggacuucaucucccgccagcugaacgacacgcgguacaucagcaaggaggccaagaacuaccucuccaagaucugcaacaacgugcagguugcccccggccagaugaccgccacccugcgccacaaguggggccugaacaccauccucaacaaggacgacgacacgaagacccgcgacgaccaccgccaccacgccaucgacgcgcuggugauggccugcagcacccgcucccaccuccaggagcugaguaagcggaaccgcuaccagaaggacuacgaguucaaggacuuccccaugcccuggcaguucuuccggcaggacgccgagaaguccguggagcagauccuggucagccacaagaagcugaacaccauccucacggugcgcacccacaagacaaagaagaacggcguggucuacaagaauaucggcguggccgcccgggggcagcugcacaaggaaaccguguucggcaagcgcaccgcgccggacgggaucgaggccuaccacguccggaagccgaucgagucccuaagcacgcacaagcacaucaacaagguaguggaugagaccauccgccuccugauccugaagcaggucaacaagcucggcggguucgugaaggguaagauccccgagggcaccuucuacaacaccgacgagaacgggaacaagcagccccagauuuuccugccgaacaagaacggcaaccccgugcccaucaagaagauccggcuccgcgaaaacaucgggggcgccgaacagcucaaguccacggucaaccagcacgugaacccccggagcaaccaccacguucugaucuacaaggacuucgacgacaaccugaaggagaaggucgugacauucuggaccgccguggagcgcaagaagcagaagcaggcggucuuccagcuuccggagaacgggaaggagaucgugaccacgcugcagaucaacgacauguuccugcucggacugaaggacgacgagaucaacugggagcaccccaaguucacccugcucaaggaacaccuguaccgggugcagaaguuuaccuccggcgacuacuacuuccgcaagcacaucgagagcaaccugaacggggagcucggcaaggccuaccaguacaucaagggguucggcgaggggaagaccggcuggaagacguuuaaccccaucaagaucaaggucagugugagcggcaagaucgagaagguguga

SEQ ID NO: 7454 - RNA, 3390 nt, Artificial Sequence
  Cas9 variant
augaacggccuggugcucgggcuggacaucggcaucgccagcgucggggccggcauccugaagaaggacaccggggagaucauccacgcgaacucccgccucuuccccgccgccaccgccgacaacaacguguuaaggcgcagcucccggcaggcccgccggagcacgcgccggaagcgccaccgggcggugcgccugcacgaccucuucgaggacuacggccugcugaccgacuucuccaaggucagcaucaaccucaacccguacaagcugcggguggagggcauggacauccagcugaccaccgaggagcuguucaucgcccucaagaacaucaucaagcgccgggggaucuccuaccuggacgacgccagcgaggacggcgugaccgucuccagcgacuacgggaaggccguggaggagaaccgcaaacuccuguccgagcagacccccggccagauccagcuggagcgguucgagaaguacggacaggugcgcggggacuuuaccgucgaggagaacggcgagaagcggcgccugaucaacguguucagcaccuccacguaccggaaggaggcggagcgcauccugcggaagcagcaggaguucaacaacaagaucaccgacgacuuuaucgacgauuaccugaccauccuuaccgggaagcgcaaguacuaccacggccccgggaacaagaagucccgcacggacuacggccgguacaccaccaagaaggacagcgagggcaaguacaucacgcuggacaacaucuuuggggugcugaucggcaagugcacguucuaccccgacgaguaccgcgccagcaaggccuccuacaccgcacaggaguuuaaccuccugaacgaccugaacaaccucaccgucccgaccgagacgaagaaacuuagcgagaagcagaagaagaccaucguggaguacgccaagaccgcgaagacucugggcgccuccacgcuccucaaguacaucgccaagaugguggacgccagcgucgaccagauccacggcuaccggguggacgucaacaaaaagcccgagaugcacacuuucgacgucuaccgcaagaugcagagccuggagaccuuuaaugugaacgagaugccccgggaggugcucgacgaacuggcccauauccugacccucaacacggaacgcgaggggaucgaggaggcgaucaacaccaagcugaagggcaccuucaaccaggaccagguccuggagcucgugcaguuccggaagaacaacuccagcuuauucuccaagggcuggcacaacuucagccugaaauuaaugauggagcugauccccgagcuguacgccaccuccgaggagcagaugacgauccucaccagacuggguaagcagaaguccaaggagaucucgaagcggaccaaguacaucgacgagaaggagaucaccgaggagaucuauaacccgguggucgccaagagcgugcgccaggccaucaagaucauaaacgaggccacgaagcaguacggcaucuucgaccacaucgucaucgagauggcgaggcugaccaacgaggaggacgccaagaaagacuacaucaagcgccagaaagccaaucucgacgagaagaacgccgccauggagaaggcggccuuccaauacaacgggaagaaggagcugcccgacuccaucuuccacggccacaaggagcuggccaccaagauccggcuguggcaccagcagggggagaagugccucuacaccggcaagaacauccccaucagcgaccugauccagaaccaguacaaguacgagaucgaccacauccugccccucucccugagcuucgacgacucccugagcaacaaggugcucgugcuggccaccgcgaaccaggagaagggccagcgcacgccguuccaggcccuggaccggauggacgacgccugguccuaccgcgaguucaagagcuacgucaaggauuccaagcuccuggggaacaagaagaaggacuaccugcucacagaggaggacaucagcaagaucgaggugaagcagaaguucaucgagagaaaccugguggacacccgcuacuccagccggguugugcugaacgcccuccaggacuucuacaagaaccaccacuucgacaccacgaucagcgugguccgcggccaauucaccucccagcugcgccggaagugggggcuggagaagucccgcgagaccuaccaccaccacgccguggacgcgcucaucaucgccgccagcucucagcugcggcuguggaagaagcagaacaacccccucaucuucuacaaggagggccaguucguggacuccgagaccggggagauccugagccugaacgacgacgaguacaaggagcucguuuucaaggcccccuacgaccacuucguggacacguuacgcuccaagaccuucgaggacagcauccuguucaguuaccagguggacagcaaguacaaccggaagaucuccgacgccaccaucuacgcgaccagaaaggccaagcucgacaaggacaagagcaaggagacguacguccuguccaagaucaaggacaucuacagccaggccgguuacgacgccuucaucaagaucuacaacaaggacaagucaaaguuccugauguaccacaaggacagccagaccuucgagaaggugaucgaggagauucuccggaccuaccccuccaaggaguucaacgacaagaacaaggaggugccgugcaaccccuucgagaaguaccgccaggagaacggccccauccggaaguacagcaagaaggggaacggccccgagaucaagagccugaaguacuacgacaagaacaucccggagagcuucaucaacaucacccccucgaacuccaagaacaaggucauccugcgccagcucaaccccuggcggacggacguguacuuuaaccaccaaaccgagaaguacgagcugcuggggcucaaauacgccgaccugcaguucgagaagaagaccggcaccuacagcaucacuaucgacaaauacaacgagaucaaggagaaggagggcgugggggagcaguccgaguucaaguucacccuguacaagaacgaccuccugcugaucaaggacaccaagaacaacgagaagcagaucuuccgcuuccuuagccggaccaugcccaacgucaagcacuacguggagcucaagccguacaacaaggcgaaguucgacggcaaccagccccugaucacgaucuucgggaacguggccaagggcgggcagugccucaaggggcugaacaagcccaacaucaguaucuacaagauaaaaaccgacguccugggcaacaaguacuucaucaagaaggagggggacaagcccaagcucaaguuuuga

SEQ ID NO: 7455 - RNA, 3390 nt, Artificial Sequence
  Cas9 variant
auggccgaccgcaucagccugggccucgacaucgggguggccuccgucggcuucagcgugcuggacaucgacaaggggaaggugaucgaacugggcucucgccucuuuaacgcgaccgucgccgaggggaaccaggaccggcggagcaugcgcggggcccggcgccugcugaaccggaacaagcagcgaagacaagacaccggcaaacuguuccagaaguucgggcuccuggauaacuucaacaaagacaacuucuacgacacguucaaccagaacuggaaccccuacgagcuccgcgugaagggccugaccgagcaccugaccaagaaggagcucgccgagagccuguaccagaucgugaagcaccgggggaucagcuacgcccugaaggacgcggacgccgacgagggcgggaccgauuacuccgcgagccucaagaucaacucccaggagcuggcugagaagacgccggcgcagauccagcugcagcgccucaacgacuacggcaaggucagaggccagguggugaucggggacgaccccgacaaccagaaggucuugcugaacguauuccccaccagcgcguacgagaaggaggccaaacaaaucauugccacccagaaacaguucuaccccgagauccucaccgacgaguucacgaaggaguacugcaagauccugacccgcaagagagacuacuucgugggcccggggaacgagaagucccguaccgacuauggcaucuacaagaccgacggccggacgcuagacaaccucuucgaagaguugauagggcacgacaagaucuaccccgacgaguugcgcgcuagcgcggcauccuacaccgcccagcuguucaauguccucaacgaccugaacaaccuucggauccugagcuacgaggacggcaagcugaccaaggaggacaaggagaagaucaucgccgagaucaaguccaacaccacaaccaucaacaugcucaacgugaucaaaaagguggccgggugcagcaaggaggacaucaagggcuuccgcgucaacgagaaggacaagcccgagaucuccagcauggcaguguaccggaagguucacaaggacuuacuaaaggucgggguggacaucagcgacuggcccguggaguucaucgacaagcucagcuucauccugacccugaacacagagaacggggagauccgcaagcaacucaacaaccgccuggucccggaguucgacuucuugaacgacgaccuuauccagcugaucaucgacaauaaggauagcuuugaaaucaagacgaacaauaaguggcaccgguucucccugaagaccaugaacaagcucaugcccgagaugcuggagcgccccguggagcaaaugacccugcucaacgagaugggccuggugaagaaggacaagaagcgguucgagaacaacaaauaccugcccuacaaggagaucgccaaggacaucuucaauccggucgcaagcaaauccgugcgcgaggcccugaaaaucgucaacgccgugcucaagaaguaugggcacaucgacuaccuggugaucgagaugccccgggacaagaaccuuaaggaagaacaggacaacauaaaggaguuccagaauaagaacaagaaggcgaaggacgccgccuucgaggccuucgucaagagcgucggcuccgagcagcgcgugaaggaagcccucagcaaaaaccgaaagcugcagaugaagaugcgccuuugguaccagcagcaggaaaucgaccccuacaacggggagacgaucgacgcgacggaccucaucaacaaccccgacaaguucgaaaucgaccacaucaucccgcaguccaucagcuucgacgacuccaucaacaacaagacccugugcuucgccagcaugaaccaggucaaaggccagaagaccccuuacgaguucaugcuggaggggcacggccagggcuacgacaaguucaaggccaccgugcucgacaacaagaacuucgaccggaacaagcgcaagaacuaccuguucgaggagaacguguccgacaucgaaacccggaagagauuucuuagccggaaccucgucgacacccgcuacuccagccggguggugcugaacucccugcaagauuucuuccacgagaaguccgccgacaccaaggucaccgugauccgcgggaaguuuacgagcaacaugcggaagcacuggcacaucgacaaaacccgcgaaaccuuccaccaucacgcgauagacgccagcaucaucgccgccacccccuuucuccggauguggaaaaagggagggacgaucuuccccgugaaggucggcgaggagucgauugacauugagaccggggagauucuggacgacaagaaguuugacaaggugauguacgaggagccguacaacggcuucguuagcgagaucaugaacgcggacgaccgcaucaaguucagccaucaggucgacaaaaagaugaaccgcaaggugucagacgcgaccaucuacagcacccggaccggcaagcuggccaaggacaagaaggacgccgaguacaucguggccaaggugaaggacauauacuccguggacggguucaagaaguucaagaaaguguacgauaaggacaagagcaaguuccuccuguacaaguacgacccacgcacguucuccgagcuggagcggaucaucagcgacugccccgacaaggucgagaaggugcagaccaacggcaaggugaaggccgucgacgugucccccuucgagauguacagacgguaccacggaaugauaaagaaguacagcaagaaagggaacgggccggcgauaaagcagcucaaguaccuggauaagaaguuggggucccacaucgacauaacccccgccaacgcaaacggcaagcacgugauccuucaaagccugaaacccuggcgcacggacgucuaccugaaccaugagacgggggaguacgagaucaugggcaucaaguacucggaccucaaguucaacaagaacgugggguauggcaucaagaaggauaaguaccuggagaucaagaagaacgaggaagugagcgagaaguccgaguucauguucagccuguaccggaaggaccgcguccggauccagaacaugaagaccggcgagucgguggagcuccuguucuggagccguaacuucuccaacaagaaguacgccgaacugaagcccaucuucaaguucgugacugaggacgacgacuggccggucuacggucaugccaagacacagauccucaagcggcuggugcccaaggacuguaagaucuggaaggugaacacgacuauccugggcgaccccuacuaccucgagaaggagagcgacaacccgaaggacauccuggacuga

SEQ ID NO: 7456 - RNA, 3390 nt, Artificial Sequence
  Cas9 variant
augaccaacggcaagauccuggggcucgacaucggcaucgccagcgugggggucggcaucaucgaggccaagaccgggaaggugguucacgcgaacucccgccuguucagcgccgcaaacgcggaaaacaacgccgagcggagaggcuuccgggguucccgccggcugaaccgccggaagaagcaccgcguuaagcgggugcgcgaccucuucgagaaguacgggaucgugacggauuuccggaaucugaaccugaaccccuacgagcuccgcgucaagggccugaccgagcagcugaccaacgaggagcuguucgcggcgcuccggaccaucagcaagcgccgggggauauccuaccuggaugacgccgaggacgacagcacgggcuccaccgacuacgccaagagcaucgacgagaaccgcagacuccugaagaccaagaccccgggucagauccagcuggagcgccucgagaaauacggacagcugcggggcaacuucacgguguacgaugagaacggggaggcgcaccgccugaucaacguauucuccaccagcgacuacgagaaggaagcccggaagauccucgagacccaggccgacuacaacaagaagaucaccgccgaguucaucgacgauuacgucgagauccugacgcagaagcgcaaauacuaccacggccccgggaacgagaagucccgcaccgacuacggucgguuccgcaccgacggcaccacgcuggagaacaucuucgggauccucaucggcaagugcagcuucuaccccgacgaguaccgggccuccaaagcgagcuacaccgcccaggaguacaacuuccugaacgaccugaacaaccucaaggugcccaccgagaccgggaagcugagcacggagcagaaagaggcccugguggaguucgccaagagcaccgccacccucggcccggcgaagcugcugaaggagaucgccaagauccucgacugcaaggucgacgagaucaagggguaccgcgaggacgacaagggcaagccggaccuacacaccuuugagcccuaccggaagcugaaguucaaccucgacuccgugaacaucgacgaccugagccgcgaggugcuggacaagcucgccgacauccugacgcugaacaccgagcgggagggcaucgaagacgccaucaagcguaaccucccgaaccaguucaccgaggagcaaaucuccgagaucaucaacguccgcaagagccagagcaccgccuucaacaagggguggcacuccuucagcgcgaagcugaugaacgagcugaucccggaacucuacgccacguccgacgagcagaugaccauccugacccggcuagagaaguucaaggugaagaaaaaguccagcaagaacaucaagaccaucgacgagaaggagaucacggacgagaucuacaaccccguggucgccaagagcgugcggcagacgaucaagaucaucaacgccgccgugaagaaguacggcgacuucgacaagaucgucaucgagaugccccgcgacaagaacgcggacgacgagaagaaguucaucgacaagcggaacaaggagaacaagaaggagaaagacgacgcccucaagcgcgccgccuaccuguacaaugggaccgacaagcugcccgacgagguguuccacgagaacaagcaguuagagaccaagauccggcugugguaccagcagggcgagcgcugccuguacuccgggaagccgauccccauccaggagcuggugcacaacucgaacaacuucgagauugaccacauccucccccugucccugagcuucgacgacucccucgcgaacaagguccugguguacagcuggacgaaccaggagaagggccagcggacccccuaccaggucaucgacuccauggacgccgccuggagcuuccgcgagaugaaggacuacgugcugaagcagaagggccucggaaagaagaagcgggacuaccugcugaccaccgagaacaucgauaagaucgaaguuaagaagaaguucaucgagcgcaaccucgucgacacccgcuacgccucccggguggugcugaacagccugcaguccgcccuccgcgagcugggcaaggacacgaaggucagcguggugcgggggcaguucaccucccagcugcgccggaaguggaagaucgacaagagccgcgagaccuaccaccaccacgcugucgacgcccucaucauugcugccagcucccagcugaagcugugggagaagcaggacaacccgauguucguggacuacggcaauaaccagguggucgacaagcagaccggugagauccucagcguauccgacgacgaguacaaggagcugguguuccagccgcccuaccagggcuuugucaacacgaucucguccaagggcuucgaggacgagauccuguucagcuaccagguggacaguaaguacaaucggaaggugagcgacgccaccaucuacagcacccgcaaggcgaagaucgggaaggauaagaaggaggagaccuacguccucggcaagaucaaggacaucuacagccagaacggguucgacacguucgugaagaaguacaacaaggacaagacccaguuucuuauguaccagaaggacccccugaccugggagaacgugaucgaggucauccuccgggacuaccccaccacgaagaaauccgaggacggcaagaacgacgugaagugcaaccccuucgaggaguaccgccgggagaacggccugaucugcaaguacagcaagaagggcaagggcacccccaucaaaucccugaaguacuaugacaagaagcucgggaacugcaucgacaucacaccccaggagagcaagaaccgcgugguccugcggcagaucuccccguggcgcgccgacaucuacuucaaccccgagacccugaaguacgagcucaugggccugaaguacagcgaccuauccuucgagaaggggaccggcaaguaccacaucagccaggagaaguacgacgccaucaaggagaaggaaggcgugggaaaggacagcgaguucaaguucacccucuaccggaacgaccugauccugaucaaggacacccucaacaacugcgagcgcaugcugcgguucggcuccaagaacgacaccagcaagcacuacguggagcugaagccccucgagaaggggacguucgacuccgaggaggagauccugcccguccugggcaagguggccaagagugggcaguucaucaagggccucaacaagccgaacaucuccaucuacaaggugcgcaccgacguccugggcaacaaguacuucgucaagaaggagggggacaagcccaagcuggacuucaaaaacaacaagaaguga

SEQ ID NO: 7457 - RNA, 3390 nt, Artificial Sequence
  Cas9 variant
augagcaacggcaagauccuggggcucgacaucggcguggccuccgucggagugggcaucaucgacucaaagaccgggaacgugauucacgccaacucccgccuguucagcgcggccaacgccgagaacaaugccgagcggcgcggcuuccggggcgcccgccggcugacccgccggaaaaagcaccgcgucaagcgggugcgagaucucuuugagaaguacgacaucuccacggacuuccggaaccugaaccugaaccccuacgagcuccgcgugaaggggcugaccgagcagcucaccaaugaggagcuguucgcggcgcuccggaccaucgccaagagacggggcaucagcuaccuggacgacgccgaagacgacuccacagggagcuccgacuacgccaagucaaucgacgagaaccgccgccuccucaagacaaagaccccgggccagauccagcuggagcgccucgagaaguacggacagcugcggggcaacuucaccguuuacgacgagaacggcgaggcgcaccgcuugaucaacguguucuccaccagcgacuacaagaacgaggccaggaagauccucgagacccaguccaacuacaacaagcagaucaccgacgaguucaucgaagacuacaucgagauccugacgcagaagcgcaaguacuaucacgggcccggcaacgagaagucccgcacggacuacgggcgguuccgcaccgacggcaccacccuggagaacauuuucggcauccucaucgggaagugcagcuuuuacccagaggaguaccgggccagcaaagcaucauauacggcgcaggaguucaacuuccugaacgaccugaacaaccucaaggugcccaccgagaccggcaaacugagcaccgagcagaaggaguaccuggucgacuucgccaagaaguccaaggcccucggggccagcaagcugcuaaaggagaucgccaagaucguggauugcagcguggacgacauuaagggcuaccgcguugacaacaaggacaagccugaccuccacaccuucgagcccuaccggaagcugaaauucaaccugaguagcaucgacaucgacgaacucagucgcgagacccuggauaaacuggcggauaucuuaacccugaacaccgagcgggaggggaucgaggacgccaucaagcgcaaccugcccagccaguucacggaggagcagaucuccgagauuguacagauccggaagaaccagagcuccgccuucaacaagggcuggcacagcuucuccgccaagcucaugaacgagcucauccccgagcuuuacguuaccagcgaggagcagaugacaauccucacccgcuuggagaaguucaaggucaacaagaaguccagcaagaacacgaagaccaucgacgagaaggagaucaccgacgagaucuacaacccggugguggccaaauccgucagacagaccaucaagaucauaaacgcggccgugaagaaguacggagacuucgacaagaucgugaucgagaugccccgcgacaagaacgcagaggacgagaagaaguucaucgacaagaagcagaaggagaacaagaaggaaaaggacgacucacugaagcgggccgccuuccucuacaacgggacggacaaccuccccgacgguguguuucacgggaacaaggagcugaagaccaagauccgccucugguaccaacagggcgagcgaugccuguacucagggaagcugaucucgauccacgaccuggugcacaacuccaacaaguucgagaucgaccacauccuccccuugagccuguccuucgacgauagccucgcuaacaaggugcuggucuacgcguggaccaaccaggagaagggccagaaaacgccguaucaggugaucgacagcauggacacggccugguccuuccgcgagaugaaggacuacguccugaagcagaagggucucgguaagaagaagugcgaguaucugcuuaccaccgagaacaucgacaagaucgaggugaagaagaaguucaucgagcggaaccuaguggacaccagguaugccucgcgggucgugcugaacucccuccaaaccgcgcuaaaggagcugggcaaggacacgaaggugagcguggugcgcgggcaauucacgagucagcugcgccgcaaguggaacauugacaagagccgggagaccuaccaucaccacgccguggacgcccucaucaucgcagccuccagccagcugaagcuguggcagaagcaggagaaccccauguucgagagcuacggcgagaaccaggucgucaacaaggagaccggggagauccucagcaucuccgacgacaaguacaaggaguugguauuccagccgcccuaccagggcuucgucaacacgaucagcuccaagggcuucgaggacgagauccuguucagcuaccagguggacuccaaguucaaccggaaggugagcgacgcgaccaucuacuccacccgcaaagccaagcuggggaaggacaagaaggacgagacguacguccugggcaagaucaaggacaucuacagccaggacggguucgacacguucaucaagcgguacaagaaggacaagacccaauuccugauguaccagaaggacccccucaccugggagaacgugauugagguuauucugcgcgacuaccccagcgagaagcugucugaagacggcaaaaagaccgugaagugcaaccccuuugaagaguaccggcgcgagaacggccucaucugcaaguacagcaagaaggggaacggcacgcccaucaagagccugaaguacuacgacaagaagcuggggaacugcauagacaucacccccgagaaguccaagaaccggguggugcuccgccagaucagcccuuggcgggcggacaucuacuucaaccuggagacccugaaguaugagcucaugggccugaaguacagcgaccuguccuucgagaaggggaccggcaaauaccacaucucgcaggaaaaguacgacgccauccgcgagaaggagggcaucgggaagaaguccgaguucaaguucacgcucuaccggaacgaccugauccugaucaaggacacccucaacaacugcgagcgcaugcugcgguucggcucgaagaaugacaccuccaagcacuacgucgagcugaagccccucgagaaggggaccuucgacagcgaggaggagauccugcccgugcugggcaagguggccaaguccgggcaguucaucaagggccucaacaagccgaacaucagcaucuacaagguccggacggacgugcugggaaacaaguucuucaucaagaaggagggggacaaacccaaacuggacuucaaaaacaacaacaaguga

SEQ ID NO: 7458 - RNA, 3390 nt, Artificial Sequence
  Cas9 variant
augagcaacggaaagauucuggggcucgacaucggcguggccucagucggggugggcaucaucgacgccaagaccgggaacgugauccacgcgaacagccgccuguuuuccgccgccaacgccgaaaacaacgccgaacggcgcggcuuccggggcgcacgccggcugacccgccggaagaagcauagagucaagcgggugcgugaccucuucgagaaguacgacaucagcacggacuuccggaaccugaaucugaaccccuacgagcuucgcgugaaggggcugaccgagcagcugaccaacgaggaacuguucgccgcccuccggaccaucgccaagcggaggggcaucuccuaccuggacgaugcggaggacgacagcacgggguccagcgacuacgccaaguccaucgacgagaaccgccggcuccuuaagaccaagaccccgggccagauccagcuggagcggcucgagaaguacgggcagcugcggggcaacuuuaccgucuacgacgagaacggcgaggcccaccgccugaucaacguguucagcacauccgacuacaagaacgaggcccggaaaauccucgagacccagagcaacuauaauaagcagaucaccgacgaguucaucgaggacuacaucgagauccucacccagaagcgcaaauacuaccacgggccuggcaacgagaagucccgcacggacuacggucgguuccgcaccgacggcaccacacuggagaacaucuucgggauucugaucgggaagugcagcuuuuaccccgaggaguaccgggccuccaaggcgagcuacacggcccaggaguucaacuuccugaacgaccugaacaaccucaaagugccuaccgagaccggcaaacugaguaccgagcaaaaagaguaucuggucgacuucgccaagaaguccaaggcccucggggccagcaagcugcugaaggagaucgcgaagaucguggacugcagcguggacgacaucaagggcuaccgcgucgacaauaaagacaagccggaccuccacacguucgagcccuaccggaagcugaaguucaaccugagcuccaucgacaucgacgagcucagccgcgagacccuggacaagcuggccgacauccucacccugaacaccgagcgggaggggaucgaggacacuaucaaacgcaaccugcccucccaauuuaccgaggaacagaucagcgagaucgugcagauccggaagaaccaguccagcgccuuuaacaagggcuggcacuccuucagcgccaaguuaaugaacgagcugauccccgagcuguacgugaccuccgaggagcagaugaccauccucacgaggcuggagaaguuuaagguaaacaaaaagagcagcaagaacaccaagaccaucgacgagaaggagaucaccgacgagaucuacaacccggugguggccaagagcguccggcagacgaucaagaucaucaacgcggccguaaagaaguacggagacuucgacaagaucgugaucgagaugcccagagacaagaacgccgaggaugagaagaaguucaucgacaagaaggagaaggagaacaagaaggagaaggacgauucccugaagcgggccgccuuccucuacaacgggaccgacaaucugcccgacggcgucuuccacgggaacaaggagcugaagaccaagauccgccuaugguaccagcagggcgagcggugccuguacagcgggaagcugaucuccauccaugaccuggugcacaacagcaauaaauucgagaucgaccacauccucccccugucccugagcuucgaugacucccucgcgaacaagguccugguauacgccuggaccaaucaggagaagggccagaagacgccguaccaggugauagacagcauggacgccgccuggagcuuccgcgagaugaaggacuacguccugaagcagaagggcaucgggaagaagaagcgggaauacuugcugaccaccgagaacaucgauaaaaucgaagugaagaagaaguucaucgagcgcaaccugguugacacccgguacgcuucccgcgucgugcugaacagccugcagaccgcccugaaggagcucggcaaggacacgaagguguccgucguacgcgggcaguucaccucccagcugaggcgcaaguggaagaucgacaagucccgggagaccuaccaccaccaugccguggacgccuugaucaucgccgcgagcggccagcucaagcuguggcagaagcacgagaaccugauguucgagaacuauggggagaaccaggucgugaacaaggagaccggcgagauucucuccaucagcgacgacgaguacaaggagcugguguuccagccgcccuaccagggcuucgucaacacgaucuccagcaagaccuucgaggacgagauacuguucuccuaccaggucgacagcaaguucaaccgcaaaguguccgacgccaccaucuacagcacccggaaagcuaagcucgggaaggacaagaaggaggagacguacguccugggcaaaaucaaggacaucuacacccaggacggauucgacaccuuuaucaagagauacaagaaagacaagacccaguuccugauguaccagaaggacccccucacgugggagaacgugaucgaggugauccugcgcgacuacccuuccgagaagcugagcgaggacggcaagaagaccgucaagugcaacccauucgaggaguaccgccgggagaacggccucaucugcaaguacuccaagaaggggaacggcacccccaucaagagccugaaguacuacgacaagaagcuggggaacugcaucgacaucacccccgaaaaguccaagaaccgcguggugcuacggcagaucagcccguggcgcgcugacaucuacuuuaaccuggagacucugaaguacgagcucaugggccugaaguacagcgaucuuuccuucgagaaggguaccggcaaguaccacaucagccaggagaaguacgaugccauccgggagaaggagggcaucgggaagaaguccgaguucaaguucacccucuaccgcaacgaccuaauccugaucaaagauacgcucaacaacugcgagcggaugcugcgcuucggcagcaagaacgacaccuccaagcacuacgucgagcuuaagccgcucgagaaggggacauucgacagcgaggaggagauccugcccgugcugggcaagguagcgaaguccgggcaguucaucaagggccuuaacaagcccaacauuucgaucuauaagguccggaccgacgugcugggcaacaaguucuucaucaagaaggaaggggacaagccgaagcuagacuucaagaacaacaacaaguga

SEQ ID NO: 7459 - RNA, 3393 nt, Artificial Sequence
  Cas9 variant
augaacaagauccugggccucgaccuggggaccaauagcauugguugggcccugaucgagaacaacaucaucuuggggaugggcucacgcguguuccccgagggggucgugaaccugggcgagggcgaggggcgggaaaccagcaagaaugccucccgcacggaggcgcggggagugcgucggcagaucuuucgcagacgccugcggaagcgauaccuucugaaggaacuggccaagcacaaccucugcccgaucucccccacccugaucaaggacuggaacgggaccgacaucuuuaaaaacgagcuaaucauccagugguuccagcucaaccccuacgagcugcgggccaaggcgauccaagaggagaucacccugaucgagcucggccgcaucuucuaccacaugauccagcggcgcggguuccugucgaacagccgguccgccggcgcggacgucaaggagacuuccaccaucuucaagggcgacgccaagaucgggaagaucggcaucuccgacacccucaaauccaucgagcagaacaagacucucggguccuuccugcacagcauccagcccaaggagaacgagccguucuccggcgaacuggagcgcauccggaaccgcuacacgacccggcagauguacaucgaugaguucgagaccaucugggaguuucagaagcaguaccacagcgagcucaacuccaaccugaagaccauccugggcgggcgcaagaaggacaacuacaaggaggacggggugcuguuccaccaacggccccugcgcagccagaagcaccuggugggguucugcuccuucgagcccaagaagacgaagugcaagcucagcgccaucccguucgagcuguuccgcaucuaccagugggucaacacccuguccuacgacgugaacggagugcggcagaaaaucacgcaagaggagcgcaagaaaaucauugaucuccugcuaagcaaagagaagccgagcuucaaggagauccggaaggccaucgggaagcucgacggcuccuaccaguucaacuacaaggacgacgacaagaucgucggcagccacaccauuuccaaccuuagcaacaagaaguuuuucgggaauaagugguucgauuucuccgagaaagagcaggagaacaucuggcacauccucagcuucuucgacgacagggagaaacuuaaggaguacgcgaucaagaacugguccuucgacgaggagcgggccgucaagaucagcaaguucaacuuaaaggauggcuacuccaaccugagccgcaaggccauccucaacaucuuacccuuccugcaaaagggguucauguacgacguggccgugggccucgccggggugaagaacacgcuguccgugaacugggaggagcacgaacaguucguccuggacaacgugcccgagaucgugcggagcaaccucaaggguggcuacaucgagccccugaagaacaugcugaagaacgaguuuaacugcaacgauaagcagcucgagaagcuguaucaccacucgagcgcgaucgagaccgagaacauccuggaccgcuuaccggucaaccuccacgccgaccgggagauacagaagaucaagaaucccguggugaucacggcccuguucgagauccgcaaacuggucaacgagguaaucgacaccuacgggaagcccaacgagauaaagguggagcuugcccgggacuugaaggccuccaagagcaaccgcuuagaggcgcggaaacgccagaaggaccucgagaaacagaacgaccgggucaagcuggaacuggagaaccucaaccagagguccaaucacaucaacauccugaaguacaaguuaugggaggagugcaaccacacgugccccuucaccggccagauuaucaccauuagccagcuguucaccggggagguacagaucgagcacauauucccuuggucccggagccuaaacgacaguuucaacaacaagacgcugugcuucgccgaugagaaccgcgccaaaggcaacaagacccccuacgagcuauacuccgagcagggggaccaaaagugggaggccaucaagcuacaagcccugagcugcuucaagaccaaagcgaacuaccccaacugcuacaacaaguucaaacacuucgucaagaagaagcacgacgaggacuucaucucccggcagcucaacgacacccgcuacauaagcaaagaggccaagaauuaccuguccaagaucugcagcaacgugcugguggcccccggccagaugacggccacccuccgccaccacugggggcuaaacuccauccugaaucucgaggacgacaccaagacccgggacgaccaccgccaucacgccaucgacgcguuagucauggccugcagcacgcggucccaccuccaggaacucagcaagcgcaaccgguacaacaagaacuacgaccugaaggacuuccccgacccuuggcagaacuuccgccaggacgccgagaacgccguggcgcagauccuggugucccacaagaaguccaagucacuucugaccguccggacccacaaaaccauuaagaagggaguggaacacaagaacaucggcguggccgcccgcgggcagcugcacaaggaaagcgucuacggccuccggaaagcccccaacuccaacaaggccuuccacauccgcaagccccuggaaagccugaccaccgagaaacagcucgagaagaucguggacgacuccauccgucugcugauccucaagcgcaucaauaucaucgggggauucaucaaaggcaagaucccgaaggagaccuucuucguggucgacgagaacgggaucaagcagccccagaucuucuuacccaaccggaacggcaaccccgugccgaucaagaaggugcgcauccgggagaacaucgggggcgcggagaagcugaaggagaacaccaaccaguacgucaacccccgcagcaaccaccacgucaucguguacgaggacucgaacgggggccucaaggacgacgucgugaccuucuggacggccguggagcggaagagacagggccaggacgucuucaagcugcccaacgacggggagaagaucguguccacacugcagaucaacgacauguuccuccugggccugaacgacgacgauaucaucacccucaccagcaaggagcugaagaagcaccuguucaaggugcagacgcucuccagcuccuucuacgaguuccggcugagcaccgacuccacccaaaacaagaacaccaacagcacgguuuuccgccggauacaguccuucgguauggggaagaccgguuggaaggccuucaacccgaucaaggugaagcugaacagcaucggggaggugaagaucaucuga

SEQ ID NO: 7460 - RNA, 3393 nt, Artificial Sequence
  Cas9 variant
augaccaauggaaagauccuggggcucgacaucggcaucgccagcgugggggucggcaucaucgaggcaaagaccgggaagguggugcacgcaaacucccgccuguucuccgccgccaacgccgagaacaacgccgagcggcgcggcuuccggggcucccgccggcugaaccgccggaagaagcaccgcgucaaacgggugcgcgaccucuucgagaaguacgggaucgugacggacuuccggaaccugaaccugaaccccuacgaacuccgcgucaagggccugaccgagcagcugaccaacgaggagcuguucgcagcccuccgcacuaucagcaagcgccgggggaucuccuaccuggacgacgccgaggaugacagcacgggcuccaccgacuacgccaagagcaucgacgagaacagacggcuccugaagacuaagaccccggggcagauccaacuggagcgccucgagaaguauggccagcugagaggcaacuucacgguauacgacgagaacggggaggcgcaucgccugaucaacguguucuccaccucugacuacgaaaaggaggccagaaagauccucgagacccaagccgacuacaacaagaagaucaccgcugaguucaucgacgacuacgucgagauucugacgcagaagagaaaguacuaccacggcccugggaacgagaagucccgcaccgacuacggccgguuccgcaccgacggcacuacgcuggagaacauauucggcauccucaucggcaaguguagcuucuaccccgaugaguaucgggccuccaaggcgagcuacaccgcccaggaguacaacuuucugaacgacuuaaacaaccucaagguucccaccgagaccgguaagcuguccacggagcagaaggaggcccugguggaguucgccaaaagcaccgcuacucuaggcccggcgaaguugcuaaaggagaucgccaagauccucgacugcaaagucgacgagaucaagggguaccgcgaggacgauaagggcaagcccgaccugcacaccuucgagccguaccggaaacugaaguucaaccucgacuccgugaauaucgacgaccugagccgcgaggugcuggacaagcucgccgacauucugacgcugaacaccgaacgggaaggcaucgaggacgccaucaagcgcaaccuccccaaccaguucaccgaggagcaaauauccgagaucaucaacguccggaaaagucagucgacggcuuucaacaagggguggcacuccuucagcgcgaagcugaugaacgagcugaucccggagcucuacgccacguccgacgaacagaugaccauccucacccggcucgagaaguucaagguuaagaagaaguccagcaagaacaucaagacuaucgacgagaaggagaucacggacgagaucuacaacccggugguagcgaagaguguccggcagaccaucaagaucaucaacgcugcugugaagaaguacggcgacuucgacaaaaucgucaucgagaugccaagagacaaaaacgcggacgacgagaagaaguucaucgacaaacggaacaaggagaacaagaaggagaaggacgacgcacucaagcgcgccgccuaccuguacaacgggaccgacaagcucccagacgaaguguuccacggcaacaagcagcucgaaaccaagauccgccugugguaucagcagggggagcgcugccuguacuccggaaaaccgauccccauccaggaacugguucacaacagcaacaacuucgagaucgaccacauccucccccugagucugagcuucgacgauucccucgcgaacaagguccugguguacagcuggacgaaccaggagaagggccagcggacccccuaccaggucaucgacuccauggacgccgccuggagcuuccgcgagaugaaggacuacgugcugaagcagaaggggcucggcaaaaagaagcgggacuaccugcugaccaccgagaacaucgacaagaucgaggugaagaagaaguucaucgagcgcaaucucgucgauacaagguacgccucccggguggugcugaacagccugcaguccgcccuccgcgagcuggggaaggacacgaaggucagcguagugcguggccaguucaccucacagcugcgccggaaguggaagauugacaagagccgcgagaccuaccaccaccacgcggucgacgcccucaucaucgccgccagcucccaacugaaacugugggagaagcaggacaacccgauguucguagacuacgggaauaaccaaguugucgacaagcagaccggcgagauccucagcgugucagacaaugaguacaaggagcugguauuccagccgcccuaccagggcuucgucaacacgaucagcuccaagggguucgaggacgagauccuguucagcuaucagguggacuccaaguacaaccggaaggugagcgacgccaccaucuacuccacccggaaagcgaagaucggcaaggacaagaaggaggagaccuacguccuagggaagaucaaggacaucuacagccagaacggcuucgacacguucguuaagaaguacaacaaggacaagacccaguuccugauguaccagaaagacccccugaccugggagaacgugaucgaggucauccucggcgacuaccccacaacgaaaaaguccgaggacgggaagaacgacgugaagugcaacccauucgaggaguaucggcgcgaaaacggccuaaucuguaaauacagcaaaaagggaaagggcacacccaucaaaucccugaaguacuacgauaagaagcucgggaacugcaucgauaucaccccugaggagagccggaacaaggugauacugcaguccaucaauccguggagagccgacgucuacuucaaccccgagacccugaaguacgagcucaugggccugaaguacucagaccuguccuucgaaaagggcacggggaacuaccacaucucucaggagaaguacgacgccauaaaggaaaaggagggcaucgggaagaagucugaguucaaguucacccucuaccgcaacgaccugauccuaaucaaggacaucgccagcggcgagcaggagaucuaucgcuuccucagccggacaaugcccaacgugaaccacuacguggagcugaaacccuacgacaaggaaaaguucgacaacguccaggagcugguggaggcgcucggggaggcggacaaaguaggccgcugcaucaaaggacugaacaagccgaacaucucgaucuacaagguccggaccgacgugcuggggaacaaguacuucgugaagaaagagggcgacaaaccaaaacucgauuuuaagaauaacaagaaguga

SEQ ID NO: 7461 - RNA, 3393 nt, Artificial Sequence
  Cas9 variant
augaccaacggcaaaauccuggggcucgacaucggcauagccagcgugggagucggcaucaucgaggccaagaccgggaagguggugcacgcgaacucccgccuguucagcgcggccaacgccgagaacaacgccgagcggcgcggcuuccggggcucccgccgucugaacaggcgcaagaagcaccgcgucaagcggguacgcgaucucuucgagaaguaugagauagugacggacuuccggaaccugaaccuaaaccccuacgagcuccgcgucaaggggcugacugagcagcucaccaacgaggagcuguucgcggcccuccggaccaucuccaagcgacggggcaucuccuaccuagacgaugccgaggacgacuccacgggguccaccgacuaugcaaagagcauugacgagaaccgccgguugcuaaagaccaagaccccaggccagauccagcucgagcgccucgagaaguaugggcagcugcggggcaacuucacgguguacgacgagaacggcgaggcgcaucgccugaucaacguguucuccaccagcgauuacgagaaggaggcccggaagauacuugagacucaagccgacuacaacaagaagaucaccgccgaguucaucgacgacuacgucgagauucugacacagaagcgcaaguacuaccacgggccuggcaacgagaagucccgcaccgauuacgggcgguuucguaccgacggcaccacgcuggaaaacaucuucggcauccuaaucggcaagugcagcuucuaccccgacgaauaccgcgcuuccaaggcuagcuacaccgcacaggaguacaacuuccugaacgaccugaacaaccucaaggugcccaccgagaccggcaagcuguccacggagcagaaagaggccuugguggaguucgcgaaaucuaccgccaccuuggggccggcgaagcugcugaaggagaucgcaaagauacucgauugcaaggucgaugagauaaagggcuacagggaagacgacaaggguaagcccgaccugcauaccuucgagcccuaccggaaguuaaaguuuaacuuggacuccguaaacaucgacgaccugucccgcgagguucuggacaaacucgccgacaucuugacgcugaacaccgagcgggagggcaucgaggacgccauccgccacaaccuccccaaccaguucacagagggccagaucagugaaaucaucaaaguccgcaagagccagagcacugccuucaauaagggguggcacagcuucagcgcgaagcugaugaacgagcugauccccgagcucuaugccacgucagacgagcagaugaccauccuaacccgguuggagaaguucaaggugaacaagaaguccagcaaaaacaccaagacgaucgacgagaaggaagugacugaugagaucuacaaccccgucguggccaaaagcgugcggcaaaccauaaagaucaucaacgccgcggucaagaaguacggcgacuucgacaaaauagugaucgagaugccaagagacaagaacgcggacgacgagaagaaguucauugacaagcggaacaaggagaacaagaaggagaaggacgacgcacucaagcgcgccgccuaccuguacaacgggaccgacaagcugcccgacgagguuuuucacggcaacaagcaacucgagacgaagauccggcugugguaucagcagggcgagcgcugccucuacucuggcaagccaauucccauccaggagcugguccacaacagcaacaacuucgaaauagaccauauucucccccugucccugagcuucgacgacucccucgcgaacaagguucugguauacgccuggaccaaccaggagaagggccagaaaacccccuaucaggugaucgacagcauggacgcggccuggucguuccgggagaugaaggacuacguccugaagcagaaggggcucggcaagaagaaacgcgacuaccugcugaccaccgaaaacaucgauaagaucgaggucaagaagaaguuuauagaacggaaccucguggacacuagauaugccagucgcgugguccugaacucccugcagucagcgcuccgggagcuggggaaagacacuaaaaucuccguuauccggggccaguuuaccucccagcuccgacgcaaguggaaaaucgacaagucccgugagaccuaccaucaccacgcgguggacgcccucaucauagccgcaagcagucaacugaagcugugggagaagcaagacaacccuauguucgucgacuacgggaauaaccagguggucgacaagcagacgggggagauccucuccgucagcgacgacgaguacaaggagcugguguuccaaccgcccuaccagggauucgugaacaugaucuccuccaaaggguuugaagacgaaauccuguucuccuaccaggucgacagcaaguacaaccgcaaagucuccgacgcaaccaucuacagcaccagaaaagcaaagaucggcaaggacaagaaggaggagaccuacgugcucgggaagaucaaagacaucuauucccagaacggauucgacacguucaucaagaaguacaacaaggacaagacccaguuccugauguaucagaaggacccacugacgugggagaacguaaucgaggugauccuacgcgacuaccccaccacgaaaaagucugaggacggcaaaaacgacgugaagugcaaccccuuugaggaguaccgccgcgagaacggccuggucugcaaauauagcaaaaagggcaaggggacgccgaucaagagccugaaauacuacgacaagaagcucgguaacugcaucgacauaacgccugaggguuccaaaaacgagguggugcugcaaucacugaacccguggcgggccgacgucuacuucaacccagagacccugaaguacgagcuguuaggccucaaguauuccgaucuuagcuucgaaaaggguacggggaaguaccauaucucccaagagaaauacgacgucauaaaggagaaggaggggaucgggaagaaguccgaguuuaaguucacccuguaccgcaacgaccugauacugaucaaggacaccgccagcggcgagcaggagaucuacagauuccugagccggaccaugcccaacgucaagcacuacgccgaacucaagcccuaugacaaggagaaguucgacaauguccaggagcugguggaggcgcugggggaggccgauaaagugggccggugcaucaagggccucaacaagucgaaccuguccaucuacaagguacgcaccgacguguuaggaaauaaguauuuugugaagaaggagggcgacaagccgaagcuagacuucaagaacaacaagaaauga

SEQ ID NO: 7462 - RNA, 3393 nt, Artificial Sequence; identical to SEQ ID NO: 1662
  Cas9 variant

SEQ ID NO: 7463 - RNA, 3393 nt, Artificial Sequence
  Cas9 variant
augagcaacggcaagauccuggggcucgacaucggcguggccuccgucggggugggcaucaucgacgcgaagaccgggaaagugauccacgcgucaucccgccuguucagugccgccaacgccgagaacaacgccgagcggcgcggcuuccggggcgcgcgccggcugacccgccggaaaaagcaccgcaucaagcggguacgcgaccucuucgagaaguacgagaucgugacggacuucuccaaccugaaccugaaccccuacgaacucagggugaaggggcugaccgaacagcugaccaacgaggagcuguucgccgcccuccgcaccaucgccaagcggcgcggcaucagcuaccuggacgacgcggaggacgacuccacggggagcuccgacuacgccaagagcaucgaggagaaccggcgccuccugaagaacaugacgccgggccagauccagcuggagcggcucgagaaguacgggcagcugcgcggcaacuucacugucuacgacgagaacggcgaggcccaccggcugaucaacguguucuccaccagcgacuacaagaacgaggcacgcaagauacucgagacgcaguccaacuacaacaagcagaucaccgacgaguucaucgaggacuacaucgagauccugacccagaaacggaaguacuaccacgggcccggcaacgagaaaucccgcaccgacuacgggcgcuaccggacggacggcaccacccuggagaacaucuucggcauuuugaucgggaagugcacauucuaccccgacgaguaccguacgagcaaggccagcuacaccgcgcaggaguacaacuuccugaacgaccugaacaaccucaaggugcccaccgagaccggcaaguuguccacugagcagaagcacuaccuggucgacuucgccaagagcuccaaggcccucggcguggcgaagcugcugaaggagaucgccaagaucguggagugcagcgucgacgacaucaagggcuaccgggaggacaacaaggggaagccugaucuccacaccuucgagcccuaccgcaagcugaaguucaaccugagccucaucgacauagacgagcugucccgggagacccuggacaagcucgcggacauccugacacugaacacggagcgcgagggcaucgaggacgcuaucaagcggaaccuccccaaccaguucaccgaggagcagaucguggagcuggugaacguccgcaagaaccagagcuccgccuucaacaaaggcuggcacagcuucuccgugaaacugaugaacgagcucauccccgagcuguacgccagcuccgaggagcagaugaccauacugacccggcucgagaaguucaaggugaacaagaaguccagugagaacacgaagaccaucaacgagaaggagaucaccgacgagaucuacaacccggucguggccaagagcgugucccagaccgucaagaucaucaacgcggccguuaagaaguacggggacuucgacaagaucgugaucgagaugccccgcgacaagaacgccgacgacgagaagaaguucaucgacaagaagcagaaggagaacgccaaggaggucgaggacgcgcugaagcgggcggccuaccuguacaacggcacggacaagcucccagacgggguguuccacggcaacaagcagcugaagaccaagauccgccugugguaccaacagggggagcggugccuguacagcggcaagcccaucuccauccaggaccucguccacaacagcaacaacuucgagaucgaccacauccugccucugucccucagcuucgacgacucccuggccaacaaggugcugguauacgccuggaccaaccaggagaagggccagaagacccccuaccaggucaucgacagcauggacgcggccugguccuuccgcgagaugaaagacuacgugcucaaccagaaggggaucggcaagaagaagcgggaguaucugcugacgacugagaacaucgacaagaucgaggucaagaagaaguucaucgagcgcaacuuagucgacacccgguacgccagccgcguggugcuuaacagcauccaggccgcccugaaggagcucgacaaggacaccaaggucuccgugauccgggggcaguucaccagccagcugcgccgcaaguggaagaucgacaagucccgggagacguaccaccaccacgccguggacgccuugaucaucgccgcaagcucccagcucaagcuguggcagaagcaggagaaccccauguucguagacuacggagagaaccagguggugaacaaggagaccggggagauccuuagcgucuccgacgacgacuacaaggagcucguguuccagcccccguaccagggcuucgugaacaccaucagcuccaaggccuucgaggacgagauccuguucagcuaccaggucgacuccaaauacaaccgcaaggugucggacgcgaccaucuacuccacgcggaaggcaaagcugggcaaggacaagaaggaagagaccuacgugcucgggaagaucaaggacaucuacagccaggacggcuucgaugccuucauaaagcgcuacaagaaggacaagacccaguuccugauguaccaaaaggaccccgucaccugggagaacgugaucgaagugauccugcgggacuaccccuccgagaaguugagcgaggacgggaagaagaacgucaagugcaaccccuuugaggaguaccgccgggagaacggccugaucugcaaguacuccaagaagggcaaggggacgccgaucaagagccugaaguacuacgacaagaagcugggcaacuguaucgacaucacccccaaggggagcaagaacgagguggugcugcagucccugaaccccuggcgcgccgaccucuacuucaacccugacacccugaaguacgagcugaugggccucaaguacagcgaucuguccuuugagaaggggaccggcaaguaccacauaagccaggagcgguacgacgagaucaaagucaaggagggcaucgggaagaacuccgaguucaaguucacgcuauaccgcaacgaccucauccugaucaaggacaccgagagcggcgaggaggagcuguaccgguuccucucccgcaccaugccgaacgugaagcacuacguugagcuuaagccauacgacaaggagcgguacgacgggggccaggagcugaugaaggucuucgggaacguggccaacggcggccagugccucaagagccugaacaaguccaaccugagcaucuacaaggugcgcaccgauguccucgggaacaaguucuucaucaagaaggagggcgacaaacccaagcuggacuucaagaacaacaagaaguga

SEQ ID NO: 7464 - RNA, 3393 nt, Artificial Sequence
  Cas9 variant
augaccaacggcaagauucuggggcucgacaucggcaucgccagcgugggcgucggcaucauugaggccaagaccgggaagguugugcacgcgaacucccgccuguucagcgcggccaacgccgagaacaacgccgagcggcgcggcuuccggggcucccgacggcugaaccgccggaagaagcaucgcgucaagcgggugcgcgaccucuucgagaaguacgggaucgugacggacuuccggaaccugaaccugaaccccuacgagcucagagucaaaggccugaccgagcagcugaagaacgaggaacuguucgcggcccuccggaccauaagcaagcgccgggggaucuccuaccuggacgacgccgaggacgacagcaccggauccacugacuacgccaagagcaucgacgaaaaccgccggcuccugaagaacaagaccccggggcaaauccagcuggagcgccucgagaaguacggccagcugcggggcaacuucacaguguacgacgagaauggggaggcgcaccgccugaucaacguguucucgaccagcgacuacgagaaggaggcccggaagauccucgagacgcaggccgacuacaacaagaagaucaccgccgaguucaucgacgacuacgucgagauccugacccaaaagcgcaaguacuaccacggccccgggaacgagaagucccgcaccgacuacggccgguuccgcacggacggcaccacccuggagaacaucuucgggauacucaucgguaagugcaacuucuacccagacgaguaucgggccagcaaggcguccuacaccgcccaagaguauaacuuccugaacgaucugaacaaccucaaggugagcacggagaccgggaaguuguccaccgagcagaaggagagccugguggaguucgccaagaacaccgccacucucggccccgcgaagcugcuuaaggagaucgcgaaaauccucgauugcaaggucgacgagaucaagggguaccgcgaggacgacaagggaaagccggaccugcacaccuucgagcccuaccggaagcugaaguucaacuuggaguccaucaacaucgacgaccugagccgcgaggugaucgacaagcuggccgacauccucacacugaacaccgagcgggagggaaucgaggacgccaucaagcgcaaccugccuaaccaguucacggaggagcaaaucuccgagauaaucaaggugcgcaaaagccaguccaccgccuucaacaaaggguggcacuccuucagcgcgaagcucaugaacgagcugaucccugagcuguacgcgaccuccgacgagcagaugaccauccuuacgcggcuggagaaguucaaggucaacaagaaguccagcaaaaacaccaagaccaucgacgagaaggaggugaccgacgaaaucuacaacccaguggucgccaagagcgugcggcagacgaucaagaucaucaacgccgccgugaagaaguacggcgacuucgacaagaucgucaucgagaugccccgcgacaaaaacgccgacgaugagaaaaaguucaucgacaagcggaacaaggagaauaagaaggagaaggacgacgcgcugaagcgcgcggccuaccucuacaauaguagcgacaagcugcccgacgagguguuccacgggaacaagcagcuggagaccaagauucggcucugguaccagcagggcgagcgcugccuguacuccgggaagcccaucagcauccaggagcuggugcacaacagcaacaacuucgagaucgaccacauccugccgcucagccugucauucgacgacagccucgccaacaagguccuaguguacgcauggaccaaccaggaaaagggccagaagacccccuaccaggucaucgacuccauggacgccgccuggagcuucagggagaugaaggacuacgugcugaagcagaagggccuggggaagaagaagcgcgacuacuugcugacgaccgagaacaucgacaagauugaggugaagaagaaguucaucgagcggaaccuggucgacacccgcuacgcaucccgcguugugcucaacagccugcaguccgcccugcgggagcucggcaaggacaccaaggucagcgugguucgcgggcaguucaccagccaacugcggcgcaaguggaagaucgacaaguccagggagaccuaccaccaccacgcggucgaugcccugaucauagccgcaagcucccagcugaagcugugggagaagcaagauaaccccauguucguggacuacggcaagaaucagguggucgacaaacagaccggggagauccugagcguguccgacgacgaguacaaggagcucguguuccaacccccguaccagggcuuugucaacaccaucagcuccaagggguucgaggacgaaauccuguucagcuaccaggucgacucuaaguacaacagaaaggugagcgacgcaaccaucuacuccacgagaaaggcgaagaucgggaaggacaagaaggaagagaccuacguucugggcaagaucaaggacaucuacucacagaacggguucgacaccuucaucaagaaguacaacaaggacaagacucaguuccucauguaccagaaggacucccugacgugggagaacgugaucgagguaauccugcgcgacuaccccaccaccaaaaaguccgaggacggcaagaacgaugucaaguguaaccccuucgaggaguaccggcgcgagaacggccucaucugcaaauacagcaaaaaggggaaaggcacccccaucaagagccugaaguacuacgacaagaagcuggguaacuguaucgacauuacgccggaagagucccggaacaagguaauccuccagagcaucaacccauggcgcgccgauguguacuucaacccugagacccugaaguacgagcugaugggccucaaguacagcgaccuguccuucgagaaggggaccgguaacuaccauaucagccaggagaaguacgacgccaucaaggagaaggagggcaucgggaagaaguccgaguucaaguucaccuuguaccggaacgaccucauccugaucaaggacaucgccagcggcgagcaggagaucuaccgcuuccugucccggacgaugcccaacgucaaccacuacguagagcucaagccguacgacaaggagaaguucgacaacgugcaggaacuggucgaggcgcugggggaggcagacaaggugggccggugcaucaaggggcucaacaagcccaacaucagcaucuacaaggugcggaccgacguccuggguaacaaguacuucgugaagaagaagggcgacaagcccaaacuggacuucaagaacaacaagaaguga

SEQ ID NO: 7465 - RNA, 3393 nt, Artificial Sequence
  Cas9 variant
augaccaauggcaagauccugggccucgacaucggcaucgccucgguuggggucgguaucaucgaagccaagaccgggaaggucgugcacgccaauucucgccuguucagcgcagccaacgccgagaacaacgccgagcgccgcggauucagaggcagccgccggcugaaccgccgaaagaagcaucgcgucaagcgggugcgcgaccucuucgagaaguacgguaucgugacggacuuccggaaccucaaccugaaccccuaugaacuccgcguuaagggccuuacugagcaacuuacgaacgaggaacuguucgcggcgcuccggacuaucucaaagcgccgggggaucuccuaccuggacgacgccgaggacgacagcacgggcuccaccgacuacgcuaagagcaucgacgagaaccgccggcuccugaagaccaagaccccggggcagauccagcuggaacgccucgagaaauacggccagcugagagguaauuuuacgguguacgacgagaauggggaggcgcaccgccuuaucaacguguucuccaccagcgacuacgagaaggaggcccggaagauccucgagacccaggccgacuacaacaagaagauaaccgccgaguucaucgacgauuacgucgagauucugacgcaaaagcggaaguacuaccacggccccgggaaugagaagucccgcaccgacuacggacgcuuccgcacagauggcacgacacuggaaaauaucuucgggauccucaucggcaagugcagcuucuaucccgacgaguaccgagccuccaaggcgagcuacaccgcacaggaguacaacuuccugaacgaucuuaacaaccucaagguacccaccgagaccgggaagcuguccacggagcagaaggaggcccugguggaguucgcuaagagcaccgccacccugggaccggcgaagcugcugaaggagauagccaagauccucgacugcaaggucgaugagaucaagggguauagagaggacgacaagggcaagcccgaccuccacaccuuugagcccuaccggaagcucaaauucaaccucgauagcgucaacaucgacuaccugucccgcgaggugcuggacaaguuggccggcauccucacgcuuaacaccgagcgagaggggaucgaggacgccaucaagcgcaaccuccccaaccaguucaccgaggagcagaucucugaaaucaucaacguccgcaagagccaaucaacggcuuucaacaagggguggcacuccuucagcgcgaaguuaaugaaugagcugaucccggagcucuacgccacguccgacgagcagaugaccauccugacccggcucgagaaguuuaagguaaagaagaaguccagcaagaacaucaagaccaucgacgagaaggagaucacggacgaaaucuacaaucccgucgucgcaaagagcgugcgacagaccauuaagaucaucaacgccgccgugaagaaguacggggauuucgauaagaucgucaucgagaugccccgagacaagaacgcggacgacgagaagaaguucaucaacaagcggaauaaggagaacaagaaggagaaggacgacgcacucaagcgcgccgcauauuuguacaacggcaccgacaaacugcccgacgagguguuccacggaaauaagcagcucgagaccaaaauucggcugugguaccagcaaggcgagcgcugccuguacuccggcaagccgauccccauccaggagcuggugcacaacaguaacaacuucgagaucgaucacauuuugcccuugagucugagcuucgacgacucccuugcgaacaagguccugguguacagcuggacgaaccaggagaaggggcagaagacgcccuaccaggucaucgacuccauggaugccgccuggucauuccgcgaaaugaaggaguacguacugaagcagaagggccucgggaagaagaagcgcgacuaccugcugaccaccgagaacaucgacaagaucgaggugaagaagaaguucaucgagcggaaccucgucgacacccgcuacgccucccgcguggugcuuaacagccugcaguccgcacuccgggagcugggcaaagacacgaaagucagcguggugcgcgggcaguuuaccucccagcugcggcguaaguggaagauugacaagagccgggagaccuaccaccaccacgcggucgacgcccucaucaucgcagccuccucccagcugaaacuuugggaaaagcaagacaacccgauguucguggacuacggcaauaaccaaguggucgacaagcagaccggcgagauccucagcguuucagacaacgaguacaaggaguuaguguuccagccgcccuaccagggguucgucaacacgaucagcuccaagggcuucgaggacgagauccuguucagcuaccagguggacuccaaguacaaccgcaaggugucugacgccacuaucuauuccacccggaaggcgaagaucggcaaggacaagaaggaggagaccuacguccucggcaagaucaaggacaucuacagccagaacggcuucgacacguucgugaagaaguacaacaaggacaagacccaguuccugauguaccagaaggacccccugaccugggagaacgugauagaggucauccucggggacuacccgacgacgaagaaguccgaagauggaaagaacgacgugaagugcaacccauucgaggaguaccgccgggaaaacggacugauauguaaauacagcaagaaggggaaggggacaccgaucaagucccugaaguacuacgacaagaagcucggcaauugcaucgacaucacccccgaggagagccgaaauaaggugauccuacaguccaucaaccccuggagagccgacgucuacuucaaccccgagacccugaaguacgagcucaugggccugaaguacagcgaccuguccuucgagaaggggacgggcaacuaccacaucagccaggagaaguacgacgccauaaaggagaaggagggaaucggcaagaaauccgaguucaaguucacccucuaccgcaacgaccucauccugaucaaggauaucgccagcggugagcaggaaauuuacagauuccucagccgcaccaugcccaacgugaaccacuacguagagcucaaacccuacgauaaggagaaguucgacaacgugcaggagcugguggaagcccucggggaagcggacaaggugggccgcugcaucaaggggcugaacaagccgaacauuuccaucuauaagguccgcaccgacguacugggcaacaaguacuucgugaagaaagagggggacaagcccaagcucgacuucaaaaacaacaagaaguga

SEQ ID NO: 7466 - RNA, 3396 nt, Artificial Sequence
  Cas9 variant
auggcgcaacacguauucggcuuggacauaggcaucgcaagcguuggcugggccauccuaggcgaacaaaggauaaucgaccuaggcgugcguugcuucgauaaagccgaaaccgccaaagaaggggacccacucaaccugacacgccgccaagcacgacuauuacgccgcagacucuacagacgagcuuggcgccuaacucaacuaucgcgacuacuaaaacgcaaaggccugauagcagacgcaaaacucuucgccaaagcacccucauacggugacucugccugggagcuacgccgccaaggccuggaccguuuacuuacgcccuuagaaugggccagagucauauaccaccaaugcaaacacaggggcuuccacuggacuucgaaggccgaagaagcaaaagccgacucggacgcagaaggcgggaggguaaaacaaggauuggcccacacgaaagcgcuuaugcaagccaagaacuaccggagcgcagcagagaugguccuagccgaguucccugacgcucaaagaaacaaacgaggacaauacgauaaagcacuaagccguguccuccucggcgaagaacucgcacuacuguucgcgacccaacgccgacuaggaaacccacacgcaucagauuucuucgaaaaacuaauacuaggcgacggagaccgaaagagcggacuauuuuggcaacagaaacccgcacucucgggagccgaccuuuuaaaaaugcucgguaaaugcacauucgaaaaaggagaauaccgggcgccaaaggccuccuucuccgucgaacgccacguauggcuaacacgccuaaacaaccuacgaaucguaguugacggcagaucaagaccucuaaacgaagcagaacggcaagcagcccuccuccuacccuaucaaaccgagaccucaaaauacaaaacccucaaaaacgccuucaucaaagcaggccuauggggagaugggguaagauucgggggucucgccuaccccucacaagcacaaaucgaugcagagaaaacaaaggauccagaagaucaauuucucguaaaacucccggcguggcacgaauuacgcaaggccuucaaggcugccgggcacgaggccuuguggcaacaaaucucuacacccgcgcucgacggcgauccaacccuacuagaccaaauagcgaccguucucuccguauacaaagacggagcggaaguaguacaacaacuacgccaacuagcacuaccagagcccgccgccucuaucgccgugcucgaaaagauuagcuucgacaaguuuucaagucucucccucaaagcgcuacgccgaaucguaccacuaaugcaaucaggacuccgauacgacgaagccgucgcccagauaccggaauacggacaccacagccaaagaaucgaacccggggcagcgaaacaccucuaccuaccgccauucuacgaagcccaacgaaaguaugcaggcaagggugaccacauagggucaaugcaauuccgggaugacgcagauaucccacgcaacccagucguucuccgagcacucaaccaagcccguaagguggucaacgcccugauacgcgaauacggcucccccauagccguaaacauugagauggcccgcgaccucagccgcccccuagacgaacgaaacaaagucaaacgggcacaagaagaguuccgagaucgcaacgaccgcgccagaagcgaguucgaacgcgacuucggguacaagccaaaggcagcagccuucgaaaaauggaugcuauaccgagaacaacuaggccaaugugccuacucccaacaaccacucgauauacaacggguucuagacgaccacaacuacgcacaaguggaccaugcacuccccuacuccaggagcuacgacgacagcaaaaacaauaaaguucucguacugacgcacgaaaaucagaacaagggcaacagaacugcauucgaauaccuaaccagcuucccagacggcgaagacggagaacgauggcgcacauucgucgccuggguacaagguaacaaggcuuaccgcauggcaaaacguaaccggcuacuacgcaaaaacuacggcgucgacgaaucuaaaggauucaucgaccgcaaccuuaacgacacacgauacaucugcaaauucuucaaaaacuacguagaggaacaucuacagcucgccgcacgcgcagacggagacacagcacgucgauguguagucgucaacggccaacuaaccgccuuccuucgggcacgcugggggcugacaaagguucgcggggacagugaccgccaccacgcccuugacgcagccguaguagcugcgugcacccacggcaugguuaaggcuuuagcagacuacagucgacguaaagaaaucagcuuccugcaagaaggcuucccagacccugagacaggugaaauacucaaccccgcugccuucgaccgagcccggcaacacuuccccgaacccuggacacacuucgcacaugaacucaaagcccgacucuucaccgaugaccucgcagcccuacgcgaagacaugcaaaggcucggaagcuacaccaccgaggaucuagggcgacugcgaacccuauuugucagccgagccccacaaagacgcagugggggcgccguccacaaagaaaccaucuacgcacagccggaaucacuuaaacaacaagggggcgucauagagaaaauccuacuaacaagccucaagcuacaagacuucgacaaacuucuaaaccccgaaagcaacgaccacuuugucgaaccgcaccguaacgaacgucuauaugcagcaauacgacaacgacucgaacaguucgguggacgcgccgauaaagcauucggcccggacaaccuguuccacaaaccagacaaaaacaaccaaccgaccggaccugucguccgcucaauaaaacucguucgcggaaagcaaacaggaauaccuauccgcggcggccuagccaaaaacgacuccaugcucagaguggacaucuucaccaaagcagguaaguuccaucuagugcccgucuacguccaucacagaguaacaggccuccccaaccgggcaauaguggcuuucaaagacgaagacgaauggacacucauagacgaaucauucgcguuccuauucagcgucuacccgaaugacuacguaaaaguuacccugaaaaaggagcaacagagcggauacuacuccggcgcagaccgcucaaccggcgcaaugaaccuaugggcgcacgaccgagcagcaucaguaggcaaagacggccuaauccgaggcauaggcguaaaaaccgcccuaagcgucgaaaaauucaacguugacguccuuggacggaucuaccucgcgccaccagagacacgguccggacucgccuga

SEQ ID NO: 7467 - RNA, 3399 nt, Artificial Sequence
  Cas9 variant
auggcccaguacgucuucggccuagacauaggcaucgccagugugggaugggcagucuuagacgcccagcgcaucgucgaccuaggaguaaggugcuucgacaaggcggaaaccgccaaggaaggcgacccgcucaaccuaacaagacgccaagcaaggcuccuacgacgccgacucuaccggagagcguggcgauuaacacaacuggcacgccucuucaagcgagaaggucuuaucgacgacgcaaaacuauucgccaaagcgcccagcuggacggaaaacgcgugggagcugcggcucagaggucuggaccaucuauuaacuccccucgaaugggcucgaguuaucuaucaucucuguaaacaccguggauuccacuggaccagcaaagcagaagaagcaaaagcggaguccgaugccgagggcggcagaguaaaacagggucucgcccacaccaaagcacucaugcagguaaagaacuaccgaucgaccgcagaaaugguccucgcagaguucccaggggcccagcgaaacaagcgcggacaauacgauaaagcgcuguccagaguccuacucggagaagaacucgcccugcuauucgcaacacaacgccggcuaggcaacccacacgcguccgaacacuucgaacagcugauacuaggacacggggaccgcaaaagcggccucuucuggcaacagaagccagcacuaucgggugccgaccugcucaagaugcugggcaaaugcaccuucgaaaagacggaauacagggccccaaaagcaucauucagcgccgaacgucacguguggcugacacgccugaauaaucuccgaauugucguggacggccgagccagaccacuaaacgacgcagaacgacaggccgcccucuuacuacccuaucaaaccgaaacguucaaauacaaaacgcuaaaagccgccuucguaaaagucggccucuggggagacggcguccgcuucggaggccuagcauaccccucccaagcgcaagccgaagccgaaaaagcgaaagacccagaagaccaguuucuggugaagcucccggcauggcacgaacucagaaaagccuuuaaagccgcaggccacgaggcacuauggcaacagauaagcaugcccgcccucgaagaagaccccacacuacuagaccaaauagccaccgucuuaagcguauacaaagacggcaccgaagucguacaacaacuccgacagcuagcucuacccgagccagacgccuccaucgcaguucuugagaaaauccgauuugacaaguucagcagucuuucccucaaagcacuaaggcgaauagucccccuuaugcaaggcggcuuacgguacgacgaagcugucgcacaaauucccgaauacggucaccacucccaacggauagaccccggagccacgaggcaccucuaccuaccucccuuuuacgaagcgcaacgcaaauacgccgggaaaggugaccgaauaggaagcaugcaguuccgugaggacgcagacguaccccgaaaccccgugguuuuacgagcccugaaccaagcuagaaaaguagucaacgcccucauacgagaauacggaucacccgucgccguaaacauugagauggcccgugaccuaagccggccccucgacgagagaaauaaaguaaaaagagcacaggaagaauuucgagaccguaaugacaaagcccggagcgaguucgaacgagacuucggguacaagcccaaaggcgcgguauucgaaaaauggaugcucuacagagaacagcuaggccagugcgcauacucccaacaaccacucgauauacaacgcguacucgacgacccaaacuacgcgcaaguagaccacgcacucccguauucccgaagcuacgacgacagcaaaaacaacaaaguccuaguacucacccgcgagaaccaaaauaaagggaaccgaacacccuucgaguaccuaacaucauucccaggaggagaggacggugagcgcuggcgugcguucgucgcauggguccagggcaacaaagccuacagaauggccaaaaggaaccgccuccuacgcaagaacuacggcacagacgaaucacggggcuucaucgaccgcaaccuuaacgacacacgauacaucuguaaauuuuucaaaaacuacgucgaagaacaccuacaacuagccgcgcgaacggacggagacacagcaagaagaugcgucguugucaacgggcaacugaccgcauuccuacgcgcgcguuggggacuagccaaaguccguggcgauucagacagacaucacgcccucgacgcagcagucguagccgcaugcacacacgggauggucaaagcacuagccgacuacagccgacggaaggaaauugccuuccuacaagagggcuucccugacccagaaacaggcgagauccucaacuuagccgccuucgaccgcgcccgcgaacauuucccagaaccauggccucacuuugcacacgagcuuaaggcccgccuauucaucgacgaccucguagccuuacgcgaggacaugcagcaccucggaagcuacgcacaagacgaccucgacagacucagaacgcuauuugucucacgugcuccccaacgccgaaacggaggggcgguacacaaaggcaccauauaugcccaacccgagaaccucaagcaacaaggcagcacuaucgagaaaauccuccucacaggacucaagcuacaagacuucgacaaacuccucaaucccgaaagcuccgaccacuucgucgaaccccaucguaacgaaagacuauacgcggcaauccgacgacgccuggaagaguucggaggaaaagccgacaaggcuuucgggcccgacaaacccuuuuacaaaccugacaaaaacggccaaccaaccggccccaucgucagaagcaucaaacugguacgcggaaaacagacaggcauaccaauuagaggagggcuagccaaaaacgacucaaugcuacgcgucgacgucuucacgaaagccggaaaauuccacuuagugcccguauacguacaccaccgcgucacuggccucccagacagagccaucguagccuucaaagacgaagaagaauggacccucauagacgaauccuacgccuuccucuucuccgucuaccccaacgacuucgucugcguacaacaaaggggaaaaccacucaucgaaggguacuacgccggauuagaccgggcuaacggcaacauaaacgucugggcccacgacagagcggccagcguuggaaaggacggcuuaauacgaggaauaggcgucaaaacggcacucagccuugagaaacuaaauguugacguacucggcagaauuuacccagcacccccggagacaagaaggggacuggcguga

SEQ ID NO: 7468 - RNA, 3399 nt, Artificial Sequence
  Cas9 variant
augaagaaaauacucggggucgaccucggcauaaccaguuucggauacgcgauccugcaagaaaccggcaaagaccucuacagaugccuagacaauucuguagucaugagaaacaaccccuacgaugagaaaagcggagaauccucacaguccauucgcuccacccagaaaagcaugagaagacugaucgaaaagagaaagaaacggaucagaugcguagcccaaacaauggaaagauaugggauccucgauuauagcgagaccaugaaaauuaacgaccccaaaaacaacccgaucaaaaaccgauggcaacugcgagcagucgacgcauggaagaggccccugaguccccaagaacuauuugcaauauuugcccacauggccaagcaccgcggguacaagucgaucgcaaccgaggaccucaucuacgaacucgagcuugaacugggacuaaacgaucccgaaaaggaaucagaaaagaaagcggacgagagacgccaaguguacaacgcccucagacaccucgaggagcuacggaagaaauacggaggcgagaccaucgcccaaacuauacaccgagcaguagaagcaggcgaccuacgcagcuaccguaaccaugacgacuacgagaaaaugauaaggcgggaagacauugaagaagagaucgaaaaaguccuucuacgccaagcagaacuaggagcacugggucuaccagaagaacaaguguccgaacucaucgacgagcuaaaagcaugcaucacagaccaggaaaugccgaccauagacgaaagucucuucggcaaauguacauucuacaaagacgaguuggcagcccccgccuacagcuaucucuacgaccuauacagacuauacaagaaacucgcagacuugaacaucgacggcuacgaagucacacaagaagaccgagaaaaaguaauagaaugggucgagaaaaagaucgcccaggggaaaaaccucaaaaagauuacgcacaaggaccucaggaaaauucucggccuagcgccagaacagaaaauauucggaguugaggacgagcgcauaguaaaagggaagaaagagccccgaacguucgugcccuucuucuuccuggcggacauagccaaauuuaaagagcucuuugcaucgauccaaaaacacccagacgcccugcaaauauuuagggaacuagcagaaauccuccaacgcagcaaaacuccacaagaagcgcucgacagacuaagggcucucauggcaggcaaaggaauagacacggacgaccgggaacuccucgaacuguucaaaaacaaacgaucagguaccagagaacuaucacaucguuacauacuugaagcccugccacuguuccuugaaggcuaugacgaaaaagaaguccaacgaauccucggcuucgacgacagggaagauuacucccgauacccaaaaucacugcgccaccuccaccuccgggaaggcaaccuauucgaaaaagaagagaacccgauaaacaaccacgcagucaaaagucucgccucaugggcgcuaggccucaucgcagaccuaagcuggagauacggaccauuugacgaaaucauccucgaaaccaccagggaugcacuccccgagaaaauacguaaagaaaucgacaaagcaaugcgagaaagggagaaagcacuagacaagauaauaggcaaguauaaaaaggaguuccccuccauagacaaaaggcuagccaggaaaauccaacuuugggaacgacaaaaaggacuugaccucuacuccggcaaagugauaaaccuuagccaacugcuugacggauccgcagauaucgaacacauaguaccacaaucccucgggggacucucgacagacuauaacacaauaguaacacucaaaucaguaaacgccgcaaaggguaaccgacuaccaggcgauuggcuagccggcaaccccgacuauagagagcgcaucggcaugcuaucggaaaagggacugaucgacuggaagaaacgcaaaaaccugcuagcacaaucccuggacgagauauauaccgaaaacacccacagcaagggaauacgagcaacauccuaccuagaagcccugguagcccaaguccuaaaacgcuacuauccauuuccagaccccgaacucaggaaaaacggcaucggagugcgaaugauccccgggaaagugacuuccaaaacacgaagccuacucggcauaaaaucaaagagccgagagaccaacuuccaucaugccgaagacgcccuaauacucagcacacucaccaggggauggcaaaaucgccuucaucggaugcugcgcgauaacuaugggaaaucagaggcagaacucaaggaacuguggaagaaauacaugccacacaucgaaggccuaacacuagcggacuacauagacgaagccuuccggagauucaugucgaaaggcgaagaaagccuauucuaccgagacauguuugacaccauaagauccaucagcuacuggguagacaagaaaccacuguccgccagcagccacaaagaaaccguauacagcagcaggcacgagguaccaacacuccgcaaaaacauacuggaagccuucgacagccucaacgucaucaaagaccgccacaaacucacgacggaggaguucaugaagcgcuacgacaaagaaauaagacaaaaacuauggcuccacagaaucggaaacaccaacgacgaaagcuacagagcaguugaagaacgcgcuacgcaaaucgcgcaaauccugacccgcuaccaacuuauggacgcccagaacgacaaagagauagacgagaaauuccagcaagcacucaaggagcucauaaccucccccaucgaggucacgggaaaacuccuccgcaagaugcgcuucgucuaugacaagcucaacgcaaugcagaucgaccgcgggcucgucgagacagacaaaaacaugcuggggauccacauaagcaaaggucccaacgaaaaacuuaucuuucgacguauggacgucaacaacgcccacgagcuccagaaggagaggucggguauacuaugcuaucuuaacgaaaugcuauucaucuucaacaagaaaggacucauccacuacgggugccucagaaguuaccuagaaaagggccaaggcagcaaauacaucgcacuauucaacccccgauucccggccaauccaaaagcacagccguccaaauucaccagcgacagcaaaauuaagcaaguaggaauuggcuccgccacgggcaucaucaaagcacaccuggaucucgaugggcacguacgcagcuacgaaguauucggcacacuacccgaaggcagcauagaaugguucaaggaggaaagcggcuacggacguguagaagacgacccgcaccacuga

SEQ ID NO: 7469 - RNA, 3402 nt, Artificial Sequence
  Cas9 variant
auggaccuaaauuaucgcaucggacucgacauugggaucgcaaguguaggaugggcgguguuggaaaauaacagcaaagacgaaccaguaagaaucgucgaccuaggaguccgccuauucgaagcggcagaggucccgaagacuggugccgcacuagccgagcccagaagagaagcacgaacaacgcggcgccgccugaggaggaggaagcacagacuggagcgaaugaaguggcuccuccaagaauacggccucauccaaaccgaagaguucaugaaacgauaucauucggcgggacucccggacguauaccgacuccgauacgagggacuggaacgcaaacugaaagaugaggaacucgcgcaaauacuaauccacaucggaaaacaccgcggcuucagaagcacacgaaaggcugaacucaaagacaaaaacgacaaagaaacgggagccguccucagcgcaacgagagaaaacgaaaagcuaauggaagaacacggcuaccggacagccggcgaaaugauauacaaagaugacaaauuccgcacaggcugcacguggaaagaagaaggcuaucgacugacaccacgaaacaaagaaggagacuacaaaaacacgaugcugcgggcauuacuggaagacgaagucaagguaaucuucgacugccagagaaaguuuggaaaccaaaaagccagcgaggagcucgagaaagcauaccucgcaauaaugaccagccagcgcucguucgacaugggacccggcaaacaacccgacgggucagcaucacccuacgcaauggagggguucggcgacagagucgggcucugcgccuuggaaccgagggaaaaacaagagccacgcgcccccaaagcagccuacacgucagaacucuucguagcacuacagaaaaucaaccaccucaggaucacggagaaaaauggaaagggccgcggacuaaccagcgaagaaagagaaagacuaagcgaccugcuacacaaaaagaaggaacucacauacggagccguccggaaagagcuacaauuagaucuccgcuaccgauucaacacgcucaacuacagcagcaagaaaaugacggaagaggagaaaauaaaagacgccgaaaaggcgaaguucguauccauggugucccacuacgaauaccgaaagcgcaugaguggcaugcuagaacaacugagcccagaggaacaagcagaccuaauggacgaggugggaaaaauccuaacacucuacaaaaacgacgacacacgaucaagggaguuccagaaacucggacuggacagcgaaaucaccgaggaacuccuggaacugaacccacgcggauuccaacacgucucccucaaagccaugaagaaacucaugccuuaucucaaagagggacucacguacgacaaagcaugugcggaggcaggauacgauuuccaaggcucgguacaaaaagagcggagccgccuacuaaaaggcaaggagauaacggauaucaucaacgauaucaacaacccaguagucaaaagaaguguuagccaaacagugaaagugauaaacgcuauuauacaaaaauacggcucaccccaggcagucaacauagagcuagcccgggaaaugagccggaacuacgacgagcggcggaaaauggaaaagcagaugaaggacagacaaucagaaaacgagcgugccaagaaagaaauacaagaauuaggaaacgcguuccccacaggacaggacauacugaaguaccgccucuggcacgaucaggacggaauuugcauguauagcgcaaagcggauaccgcucgcagaacucuucacaggggccuacgacaucgaucacauacugccauacucaaucacguuugaugacagcuaccgcaacaaaguccucgugaccagcgaagaaaacaggcaaaaaggaaaccgcauccccuaugaguauuucggcagugacagcgaacgcuggagcaaauucgaaacccuagucaacagccgaauccgcgacuaccgaaaacaacaaaaccugcucaaacaaucguucaccgaagaggaaagaaaagaguucaaacaacgaaaucucaacgacaccaaauacauaacccgggucauauacaacaugauacgcgagaauuuagcccucgcacccuacaacagcccgggcaaaaagaaacaaguauucgccgugaacggcggcgugacagcauaccuaaggaaaagauggggaaugucggcaaaagaccggucgauagacacacaccacgcccgagacgcagucguaaucgccugcugcacagacggcaugauacagaaaauaagcaggaacauacaaggccgugaacuacucuacgcacgcggcuucaccgcaguagacguagagacaggcgagaaauucacccgggacgacuuuacgagagaccaaugggacgaaauauucggaguacaaguaccgaaaccaugggaguacuuuaacgaggaacuagacauaagacucggcgagaacccgguagaguucaucgaaacucacucagacgugagccggaaacuugacuacccagccugguucuacgagaauaacauuaucagaccgguguucgucagcaggaugccaaaccgcaaagucaccggagccgcccacgcggacacaauacgcuccccaagacacuaucaagaaacgggaucaguacugaccaagacagcacucauagaccuaaaacugaacaagaaaacgggcgaaaucgagaacuacuacaaaccagagagugacacccuccuguauaacgcucuaaaagaacgccucgaacuauacggaggagacgggaagaaagcauuugaagaacccuucuacaaacccaaagccgacggaagccgaggaaaccucguccggaaagugaaaacguacgacaaguuaacccuaggcguguaugugaacagccaacacggaaucgccgccaacgcaaacggcucuaugguacgggucgacguauuccgaguauccggaaaguacuacuucguacccguauacauagcagacgucguccgcaagcggcuaccaaugaaggccgugguccaaggcaaacaauacauagacuggaaagaaauggaagacaaggacuucauauuuagccuauauaccagagaucugauauccuucaaauccaaaaauggaaagaaagugacaugcguggacggcacauccaaagcaguaaacgaagagaucguguacuacuauggcgccaacaucucgacagccucguuuuccggcaagagccacaacggguccuucgaguucacgagccuagggauccaaggccucgaauaccugaagaaguaccaagucgacguucuaggcaacguaagcgaagucaaacgugagaaaagaaugggcuuccgcuga

SEQ ID NO: 7470 - RNA, 3402 nt, Artificial Sequence; identical to SEQ ID NO: 1670
  Cas9 variant

SEQ ID NO: 7471 - RNA, 3405 nt, Artificial Sequence
  Cas9 variant
augaauggcuuagugcucgggcuggacaucggcaucgccagcgucggggugggcauccuggagaagaacuccgggaagaucgugcacgccagcagccgcauauuccccgcggccaccgccgacaacaacgucgagcggcgcaaaaaccggcaagcucggcggcuccaccgccguaagaagcaccgcggcgcccggcugaaggaccuguucgaguacuauggccuacuuaccgacuucagcaagguguccaucaaucugaacccguaccgccuccggguggacggguuagaccagcagcugacgaacgaggagcuguucaucgcgcucaagaacaucguaaagcgccggggcaucagcuaccuggaugacgcgagugaggacgggggcaccgugagcuccgacuacggaaaggccgucgaggagaaccgcaagcuccuggccgagcagacccccggccagauccagcuggagcgguucgagaaguacggccagcuaaggggagacuuuaccgucguggagaacagcgagaagugccggcugaucaacguguuuuccaccagcgcguacaagaaggaggccgagaggauccugcggaaacagcaggaguucaacaaucagaucaccgaugaguucaucgaagacuaccucaagauccugaccgggaagcgcaaguacuaucaugggcccggcaaugagaagucccggaccgacuacggccgcuuccgcacggacggggccacccuggacaacaucuucggcauccucaucggaaagugcaccuucuaccccaaugaguaccgggccagcaaggccuccuacaccgcgcaggaguucaacuugcugaacgaccucaacaaccugacggucccgaccgagaccaagaagcugagcgaggagcagaagaagaccaucauagaguaugcgaaguccgccaagacgcugggcgccagcacccugcugaaguauaucgccaagaugaucgacgcguccguggaccagauccgcggguaccggguggacgucaacaacaaacccgagaugcacaccuucgaaguguaucgcaagaugcagagccucgagaccaucagcgugggcgagcugucccggaacauucuggacgagcucgcccauauacugacccugaacaccgagcgcgaggggaucgaggaggccaucaacaccaaguugcgcgacagcuucucccaggaucaaguacuggagcuagugcaguuccgcaagaacaacagcucccucuucagcaagggguggcacaacuucucccugaagcugaugauggagcucauccccgagcuguaugagaccagcgaggagcagaugacgauacugacccgguuaggcaagcaaaagagcaaggagaccagcaagcgcaccaaguacaucgacgagaaggaggugacggaggagauuuacaaccccgucguggccaaguccgugcggcaggccaucaagaucaucaacgaggcgaccaagaagcacgggaucuucgacaacaucgucaucgagauggcucgcgaaaacaacgaggaggacgcuaagaaggacuacaucaagagacagaaggccaaccaggaugagaaguacgccgcgauggagaaggccgccuuccaguacaacgguaagaaggaacugccggacaacaucuuccacgggcacaaggagcuagcuaccaaaauccgccuguggcaccagcagggcgagaagugcuuauacaccggcaagagcauccccaucuccgaucugauccacaaccaguacaaguacgagaucgaccacauccugccccucagccuguccuucgacgacucccugucuaacaagguacucguacuggcgacggcuaaucaagagaaggggcagcggacacccuuccaggcccuggacagcauggacgacgcaugguccuaccgcgaguucaagagcuacgugaaggagagcaagcuccugggcaacaagaagaaggaguaccugcucacagaggaggacaucuccaagaucgaagugaagcagaaguucaucgaacggaaccuggucgacaccagguacagcuccaggguggugcugaacgcccuccaggacuucuacaaaaaccacaacuucgacacgaccaucagcgucgugcgcgggcaguucaccucccagcugcggcggaaguggggccuggagaaaucccgcgaaaccuaucaccaccaugcgguggacgcccuuaucaucgccgcgagcagccagcugcggcuguggaagaagcagaacaacccgcucaucgccuacaaggaagggcaguucgucgacucccagaccggcgagaucaucucacugaccgacgacgaguacaaggagcugguguucaaggcgcccuaugaccacuucguggacacccucuccagcaagaccuuugaggacuccauccuguucagcuaccaggucgacucuaaauucaaccgcaagaucagcgacgccaccaucuaugccacgcggaaggccaagcuggacaaagagaagaaagaguauaccuacacccucggcaagaucaaggacaucuacucccuggggaccaagacgcccagcaagaccggcuuuuacaaguuccucgacuuauacaacaaggacaagagccaguuccugauguuccagaaggaccgcaagaccugggacgagguaaucgagaagaucauggagcaguaccggcccuucaaagaguaugacaaggccgggaagcugguggacuucaacccguucgagaaguaccgccaggagaacggccccauccggaaguacuccaaaaaggguaacgggcccgagaucaagagccucaaguacuacgauauccugcugggcaagcacaagaacaucacccccgaggggucccgcaacacggucgcgcuccuaucgcuaaacccguggaggaccgacguguacuacaacauggaaaccaagaaguaugaguuccucggccugaaguacgccgaccugcccuucgaggagggcggugccuacggcaucuccaccgagacuuacaacgagcuccgcgaaaaggagggaaucggcaagaacagcgaguucaaguucacccuguacaagaacgaccugauccucaucaaggauaccgagaccaacugccagcaguucuuccgauucuggucccgcacgggcaaggacaaccccaagagcuucgagaagcacaagaucgagcugaagcccuaugagaaggccaaguuugagaagggcgaggagcuggaggugcucgggaagguaccgcccuccagcaaucaguuccagaagaacaugcagaucgagaaccuguccaucuacaaagugaagaccgacgugcugggcaacaaacacuucaucaagaaagagggugacaagcccaaacucaaguuuuga

SEQ ID NO: 7472 - RNA, 3405 nt, Artificial Sequence
  Cas9 variant
augaacggccuggugcuuggucuggacaucggaaucgcaagcgucggggugggcauccucgagaaaaauuccgggaagauaauccacgccaacagccgccucuuccccgcggccaccgccgacaacaacguggagcgucgcaagaauagacaggcccgccgccugaaccgccggaagaagcaccgcggcguccgguuccaggaccuguucgaggacuacggccuccugaccgacuucuccaaggugucaaucaaccugaacccguacaggcuccggguggacgggcugaaccagcagcuaacgaacgaggagcuguucaucgcacucaagaacaucgucaagcgccggggcaucuccuaccuggacgacgcgagcgaggacgggggcgcuguguccagcgacuacggaaaggccguggaggagaaccgcaagcuccuggccgagcagacccccggccagauccagcuggagcgguucgagaaguacggccagguccgcggggacuucaccgucguggagaacggcgaaaagcuccggcugaucaacgucuucuccaccagcgcguauaagaaggaggcagaacgcauccuacggaagcaacaggaguucaacaaccagaucacggacgaguucaucgaggacuaccuaaagauccugaccgggaagcgcaaguacuaccacggccccggcaacgagaagagucggaccgacuacgggcgcuuccgcaccgacggcacgacccuggacaacaucuucgggauccucaucggaaagugcaccuucuaccccgaagaguaccgggccagcaaggccagcuacaccgcccaggaguucaaccugcugaacgaccucaacaaccugacggugccgaccgagaccaaaaagcugagugaggagcagaagaaggugaucgucgaguacgcgaaggaagccaagacccucggggccuccacgcugcugaaguacaucgccaagaugaucgacgccagcguggaccagauccgcggguauagagucgacgucaacaacaagcccgagaugcacaccuucgagguguaccgcaagaugcagagucucgagacgaucucagugggcgagcugucccggaacguccuggacgagcucgcgcacauccugacccugaacacggagcgcgaggggauggaggaggccauuaacaccaagcucaaggacagcuuuagccaggaccaggugcuggagcuggugcaguuccggaagaacaacuccagccucuucuccaagggcuggcacaacuucagccugaagcugaugauggagcucaucccagaacuguacgagaccuccgaagaacaaaugaccauccugacgcgccucgggaagcagaaguccaaggagaccagcaagcggaccaaguacaucgacgagaaggagcugaccgaggagaucuacaaccccgucguagccaagagcguccgccaggccaucaagaucaucaacgaggccacgaagaagcacggcaucuucgacaacaucgugaucgagauggcgcgggagaacaacgaggaggacgccaagaaggacuacaucaagcgccagaaggcuaaccaagacgagaagaacgccgccauggagaaggcggccuuccaguacaauggaaagaaggagcugccggacaacaucuuccacggccacaaggagcuggccaccaaaauccggcucuggcaccagcagggagagaaaugccuguacacggguaagaccauacccauuuccgaccugauccacaaccaguacaaguacgaaaucgaccacauccucccccugagccuauccuucgacgacagccucucaaacaaggugcugguacuggccacggcgaaccaggagaagggccagcgcacccccuuccaagcgcucgacagcauggacgacgccugguccuacagagaguucaagagcuacgugaaggaguccaaacugcuggggaacaagaagaaggaguacuugcugaccgaggaagauaucagcaagaucgaggugaagcaaaaguucaucgagcgcaaccugauugacacucgguacuccagccgcgucgugcucaacgcccugcaggacuuuuacaaggcccauaaguucgacacgaccaucagcguggucagaggccaguucaccucccagcugcgccgcaagugggggcucgagaagucccgggagaccuaccaccaccacgcgguggaugcccugaucauagccgccagcagccagcugcgccuuuggaagaagcagaacaacucucugauuagcuacaaggagggccaauucguggacuccgagaccggcgagaucaucagccugacggacgacgaguacaaggagcucgucuucaaggccccguacgaucacuucguggacacccugcgguccaagaaguucgaggacagcauccuguucuccuaccagguagacucgaaguuuaacaggaagaucuccgacgcgacgaucuacgcgacccggaaggccaagcucgacaaggagaagaaggaguacacguacacccuggggaagaucaaggacaucuacucgcuaggcaccaaggccccaucaaagaccggguucuauaaauuccucgaccuguacaacaaggacaagagccaguuccugauguuccagaaggaccgcaagacgugggaugaggucaucgagaagauuauggagcaguaccggcccuucaaggaguacgacaagaccgggaaacuuguggacuucaaccccuucgaaaaguaccgccaggagaauggcccgauccggaaguacuccaagaaggggaacggccccgagauaaagagccugaaguacuacgacauccugcucgggaaacacaagaacaucacgcccgagggcagccgcaacaccguggcccugcugucccucaaccccuggcggacggacgucuacuacaacauggagaccaaaaaguacgaguuccuggggcugaaguacgcugaccucccguuugaagaagggggcgccuacgggaucucaacugagaccuacaacgaacugcgcgagaaggagggcaucgggaaaaacucggaguucaaguucacgcuguacaagaacgaccucauccugaucaaggacaccgagaccaauugccagcagaucuuccgguuuuggagucgcacaggcaaggacaaucccaaguccuucgagaagcacaagaucgagcugaagcccuacgagaaagcccgguucgagaagggagaggagcucaaggugcugggcaaggugcccccgagcuccaaccagcuccagaagaacaugcagauagagaaccucagcaucuacaaggucaagacggaugugcugggcaacaagcacuucaucaagaaggagggggacgagcccaagcugaaguucuga

SEQ ID NO: 7473 - RNA, 3405 nt, Artificial Sequence
  Cas9 variant
augaacggccuggugcucgggcuggacauuggcaucgccagcgucggggugggcauccuggagaaaaauuccgggaagaucauccacgagaauagccgccucuuccccgccgcgaccgccgacaacaacguggagcggcgcaagaaccggcaggcgcgccggcugaaccgccggaagaagcaccgcggcguccgguuccaggaccuguucgaagacuacggccuccugaccgacuucuccaaggugagcaucaaccugaaucccuaccgccuccggguggacgggcucaaccagcagcucacgaacgaggaacuguucaucgcucucaagaacaucgucaagcgccggggcaucuccuaccuggacgacgccagcgaggacgggggcaccgugcccuccgacuacgggaaggcgguuaaggagaaccggaagcuccuggccgagaagacccccggucagauccagcuggaacgguucgagaaguacggacagcuccgcggggacuucaccgucgaggagaacggcgagaagugccggcugauuaacguguucagcacguccgccuacaagaaggaagccgagcggaucuuaagaaagcagcaggaguucaacaaccaaauuaccaacgaguucaucgaggacuaccucaagauccugaccgguaagcgcaaguacuaccacggccccgguaaugagaagucccggacagacuacgggcgcuuccgcacggauggcaccacccuggauaacaucuucgggauccucaucggcaagugcaccuucuacccagaggaguaccgagugagcaaggccagcuacacugcccaggaguuuaacauccugaacgaccugaacaaccucaccguccccaccgagaccaagaagcuguccgaggagcagaagaaagacauuguggaguacgccaaggagacaaagacccugggugcuagcacccuccucaaguacaucgccaagaugaucgacgcguccguggaccagauccgcgguuaccgggucgacgugaacaacaagcccgagaugcacaccuucgagguguacaggaagaugcagagccuagaaacgaucuccgucggcgagcucagccggaacgugcuggacgaguuagcccacauccucacccuuaacaccgagcgcgaggggaucgaggaagccaucaacaccaagcugaugggcguguucucccaggaccagguccucgagcuugugcaguuccggaagaacaacagcagccuguucuccaagggguggcacaacuucucgcucaagcugaugauggagcugauccccgagcucuacgaaacguccgaggagcagaugaccauucugaccaggcugggcaagcagaaguccaaggagaccagcaagcggaccaaguacaucgacgagaaggaggucaccgaggagaucuacaacccggucguugccaagagcguccgccaggccaucaagaucaucaacgaggcaacaaagaaguacggcaucuucgacaauaucguuaucgagauggcccgagagaacaacgaggaagacgccaagaaagacuacaucaagcgccaaaaggccaaccaggacgagaagaacgccgcuauggagaaggccgccuuccaguacaauggcaagaaggagcuccccgacuccaucuuucacggccacaaggagcuggccaccaagauccggcuguggcaccagcagggggagaagugcuuguacacggggaagaacauccccaucagcgaccucauccacaaccaguacaaguacgagaucgaccacauccugccccugucccucagcuucgacgacucccugagcaacaaggugcugguccucgccaccgcgaaccaggagaagggacagcgcaccccguuccaggcccuggacuccauggacgacgccuggucauaccgggaguucaaguccuacguaaaggacagcaagcuacucuccaacaagaagaaggacuaccugcugaccgaggaggacaucagcaagauugagguuaaacagaaguucaucgagcgcaaccucgucgacacgcgguacuccagccgcguagugcugaacgcccugcaggacuucuacaaagcgcauaaguuugacaccacgaucagcgucguccggggccaguucaccucccagcuccgccgcaagugggggcuggagaagucccgggagaccuaccaccaccaugcuguggacgcauuaaucaucgccgccagcagccagcuccgccuguggaaaaagcagaacaacccccugaucacguacaaggaaggccaguucgucgacuccgagaccggggagaucaucagccucacggaugacgaguacaaagagcugguguucaaggcgcccuaugaccacuuuguggacacccugagaucaaagacguucgaagacucaaucuuauucuccuaccaggucgacagcaaguucaaccgcaaaauauccgacgccaccaucuaugccacccggaaggccaaguuagauaaggagaagaaggaguacaccuacacgcuggggaagaucaaggacaucuacagccucggcaccaagacccccuccaagaccggguucuacaaguuccuggaccuguacaacaaggacaagucgcaguuccucauguuccagaaggaccgcaagacgugggacgaggugaucgagaagaucauggagcaguaccggccuuucaaggaguacgacaaaaccggcaagcugguggacuucaacccuuucgagaaguaccgccaggagaacggccccaucugcaaguacuccaagaaggggaacggccccgagaucaagagccugaaguacuacgacauccuccuggggaagcauaaaaacauuaccccggagggcucccgaaacaccgucgcccugcucagccugaaccccuggcgcacggacguguacuacaacauggagaccaagaaguacgaguuccuggggcucaaguaugcggaccugcccuuugagaagggcggcgccuacgggaucagcaccgagaccuauaacaagcugcgggagaaggagggcauagggaagaacuccgaguucaaguucacgcucuacaagaacgaccugauccugaucaaagacaccgagaccaacugccagcagaucuuucgcuucuggagucggaccgggaaggacaaccccaaguccuuugagaagcacaagaucgagcucaagccguacgagaaggcccgcuuugagaagggcgaggagcuggaggugcugggaaaggucccgcccucauccaaccaguuccagaagaacaugcagaucgagaaccucagcaucuacaaggugaagacggacgugcugggcaaaaagcacaucaucaagaaggagggugacgagcccaagcugaaguucuga

SEQ ID NO: 7474 - RNA, 3405 nt, Artificial Sequence; identical to SEQ ID NO: 1674
  Cas9 variant

SEQ ID NO: 7475 - RNA, 3405 nt, Artificial Sequence
  Cas9 variant
augaacggccuggugcucgggcuggacaucggcaucgccagcgagggggucggcauccuggagaagaacuccgggaagaucauucacgccaacagccgccucuuccccgcggccaccgccgacaacaacguggagcggcgcaagaaccggcaggcccgccgacugaaccgccggaagaagcaccgcggcgugcgguuccaggaccuguucgaggacuacggucuccuaaccgacuucuccaagguaagcaucaaccugaacccauaucgccuccggguggacgggcugaaccaacagcugaccaacgaggaacuguucaucgcccucaagaacauagugaagcgccggggcaucuccuaccuggacgacgcgagcgaggacgggggcgccgucuccagugacuacgggaaggccguggaggaaaaucgcaagcuccuggccgagcagacccccggccagauccagcuggagcgguucgagaaauacggccagguccgcggggacuucaccgucguggaaaacggcgagaagcuccggcugaucaacguguucuccaccagcgcguacaagaaggaggccgagcgcauccugcggaagcagcaggaguucaacaaccagauaacggacgaguucaucgaggacuaccucaagauacugaccgggaagcgcaaguacuaccacggccccggcaacgagaagucccggaccgacuacgggcgcuuccgcacugacggaacgaccuuagacaacaucuucgggauccucaucggcaagugcacuuucuaccccgaggaguaccgggccagcaaggccuccuacaccgcccaagaguucaaccugcugaacgaccucaacaaccugacggucccgacugagacgaagaagcugagcgaggagcagaagaaggugaucguggaguacgcgaaggaggccaagacccucggggccuccacgcugcugaaguacauugccaagaugaucgacgccagcgucgaccaaauccgcggcuaccggguggacgugaacaacaagcccgagaugcacaccuucgaggucuaccgcaagaugcagucccucgagaccaucagcgugggcgagcugucccggaacgugcuggacgagcucgcgcacauccugacccugaacacggagcgcgaggggauggaggaggccaucaacaccaagcucaaggacagcuucagccaggaccagguccuggagcuggugcaguuucggaagaacaacuccagccucuucuccaagggcuggcacaacuucucuuuaaaacugaugauggagcucauccccgagcuguacgagaccuccgaggagcagaugaccauacugacgcgccucgggaagcaaaaguccaaggagaccagcaagcggaccaaguauaucgacgagaaggagcugaccgaggagaucuacaaccccguggucgccaagagcgugagacaggccauuaagaucaucaacgaggccacgaagaagcacggcaucuucgacaacaucguaaucgagauggcgcgggagaacaacgaggaggacgccaagaaggacuacaucaagagacagaaggccaaccaggacgagaagaaugccgccauggagaaggcggccuuccaguacaacgggaagaaggagcugccggacaacaucuuccacggccacaaggagcuggccaccaagauccgacucuggcaccaacagggcgagaagugccuguacaccgggaagaccauccccaucuccgaccugaucuacaaccaguacaaguacgagaucgaucacauccucccccugagccuguccuucgacgacagccucagcaacaaggugcuggcccuggcgacggccaaccaggagaagggccagcgcacccccuuccaggcccucgacagcauggacgacgccugguccuaccgggaguucaagagcuacgugaaggaccugaaaucccugagcaacaagaagaaggacuaccuccugaccgaggaggacauuuccaagaucgaggucaagcagaaguucaucgagcgcaaccugguggacacccgguacagcagccgcgugguccucaacgcccugcaggacuucuacaagagucaccaguucgacacgaccaucagcguggugcgggggcaguucaccucccagcugcgccgcaaguggggccucgagaagucccgggagaccuaccaucaccacgcggucgaugcccugaucaucgccgccagcagccagcugcgccucuggaagaagcagaacaacccgcugaucaccuacaaggaggggcaguucguggacucccagacgggcgagaucaucagccugaccgacgacgaguacaaggagcucguguucaaggcccccuacgaccacuucgucgacacccuguccagcaagaccuuugaagacuccauccuguucagcuaccagguggacuccaaguucaaccggaaaaucucugacgcgacgaucuacgccacccgcaaggccaagcucgauaaggagaagaaggaguacaccuacacccugggcaagaucaaggacaucuacucccuggggacgaagacccccagcaagaccggcuucuacaaguuccucgaccuguauaacaaggacaagucccaguuccugauguuccagaaggaccggaagaccugggacgaggugaucgagaagaucauggagcaguaccgccccuucaaggaguacgacaagacggggaagcucgucgacuucaacccguucgaaaaguaccggcaggagaacgagcccauacgcaaguauagcaagaagggcaacggccccgagaucaagagccugaaguacuacgacauccugcucgggaagcacaagaacaucacccccgagggcucccggaacaccguggcccugcugagccucaacccguggcgcaccgacguguacuacaacauggagacgaagaaguacgaguuccuggggcugaaguacgccgaccuccccuucgaggagggcggggcguacggcauuuccaccgagaccuacaacgagcugcgggagaaggaggguaucgggaagaacagcgaguucaaguucacccuguacaagaacgaccucauccugaucaaggacacggagaccaacugccagcagaucuuccgcuucuggagccgcacgggcaaggacaaccccaagagcuucgagaagcacaagaucgagcugaagcccuacgaaaaggcccgcuucgagaagggggaggagcucgagguccugggcaaggugccgcccuccagcaaccagcugcagaagaacaugcagaucgagaaccucuccaucuacaaggugaagaccgacguccuggggaacaagcacuucaucaagaaggagggcgacaagcccaaacugaaauucuga

SEQ ID NO: 7476 - RNA, 3408 nt, Artificial Sequence
  Cas9 variant
augagcgaccuggugcuuggccuggacauagggaucggcuccguaggggugggcauacugaacaagguaaccggggagaucauccacaagaacagccgcaucuuccccgcggcccaagcggagaacaaccucgagcggcgcaccaaccggcagggucgcagguugacgcgcaggaagaagcaccgccggguacgccuuaaccacuuguuugaagaguccggucugauuaccgacuucaccaagguguccaucaaccugaacccguaccagcuccgggugaaggggcugaccgccgagcugucaaacgaggagcuguucaucgcauuaaagaacauggucaagcaucgcggcaucagcuaucuggacgacgccucagacgacgggaacaguuccgugggcgacuacgcacagaucgugaaggagaauagcaagcagcucgagaccaagacccccgggcagauccagcuggagcgguaccaaaaguacggccagcugcgcggcgacuucaccgucgaggaggaugggcggaagcacagacucaucaacguauuccccacuucggcguaucacgccgaggcccugagaauccugcaaacgcaacaggaguucaacccccagaucaccgacgaguucaucaacagcuaccucgagauccugaccggcaagcgcaaguacuaccacgggccgggcaacgagaaaucccggaccgacuacggcaaguacacuaccaagaaggacgcacagggacaguacauuacccugaacaacaucuucggcauacucaucgggaagugcaccuucuaucccgaggaguaccgcgcggcuaaggcgagcuacacggcccaggaguucaaccugcugaacgaucucaacaacuugaccgugcccaccgagaccaagaagcuguccgaggagcaaaaguaccagaucaucacuuaugucaagaacgagaaggccauggggccugcgaagcuguuuaaguacaucgccaagcuccucgcaugcgacaucgccgauaucaaagguuaccggaucgacaagagcgacaaagcggagauccacaccuuugaggcuuacaggaagaugaagacccucgagaccaucgacaucgaacagaucgagcgagaaaagcuggacaagcuggcuuacgugcucacgcugaacaccgagcgggagggcauccaggaagcccuagaccacgaguucgccgacggcaccuuuucccaggaacagguggacgagcucgugcaguucagaaaggccaacagcuccaucuucgggaagggcuggcacagcuucagcgugaagcugaugauggagcugaucccugagcucuacgcgaccuccgaggagcagaugacuauccuuacucggcuggggaagcagaagaccaccagcuccagcaacaagacgaaguacaucgaugagaagcagcucaccgaggagaucuacaacccuguggucgccaaguccgugcgccaggccaucaagaucgugaaugccgcaaucaagaaguacggcgacuucgacaauaucgucaucgagauggcgcgggagaccaacgaggacgacgagaagaaggccauccagaagauccaaaaggccaauaaggcagagaaggacgccgcgaugcgcaaggccgccaaccaguauaacgggaaggccgagcugccccacagcguguuccacggccacaagcagcuugcgacuaagauccgguuauggcaccagcagggcgaacgcugccuguacacggggaagaccaucuccauccaugaccugaucaacaaccccaaccaguucgagaucgaccacauccugccacucaguaucacguucgacgacucccuggccaacaaagugcuggucuacgccaccgccaaccaagagaagggccagcggacccccuaucaggcccucgacagcauggacgacgcuugguccuuuagggagcugaaggcguucgugcgggagagcaaggcucuauccaacaagaagaaagaguaccugcugacggaggaggacaucagcaaguucgacguccgcaagaaauucaucgagcggaaccugguggacacgcgcuacgcguccagggugguccucaacgcccugcaagagcacuucaaagcccacaagaucgacaccaaggugagcgugguacgcgggcaauucaccucccagcugcgacgccacuggggcaucgacaagacgagagacaccuaccaccaccacgcgguggacgcccucaucaucgccgcgagcucccagcugaaccuauggaagaagcagaagaacacacucgugagcuacagcgaagaccagcugcuggacaucgagaccggggagcucaucuccgacgacgaauacaaggagagcgucuucaaggcccccuaccagcacuucguggauacccugaaguccaaggaguucgaagacagcauccuguucaguuaccaaguggacagcaaguucaacaggaagaucuccgaugccaccaucuacgccacccgccaggccaaagucggcaaggacaagaaggacgagaccuacgugcucggcaaaaucaaggacaucuacgcgcuggggacgaagaccccgagcaagacagguuucuacaaauuccuggaccucuacaacaaagacaagucccaguuccugguguaccagaaggaccggaagaccugggacgaggucauugagaagaucauggagcaauaccgcccguucaaggaaagcgauaaaaacggcaaggagguggauuuuaaccccuucgagaaguaccggaucgagaacggccccauucggaaguacucucgcaagggcaacggacccgaaaucaagagccugaaguacuacgccuccaagcucggcaaccacaucgacaucacgccgaaagacagcaacaauaaggugguccugcaauccgugagccccuggcgcgccgauguguacuucaacaaaaccaccggguccuacgagaucuuaggccucaaauacgccgaucugcaguucgagaaggggaccggcacuuaccggauuagcgaggagaaguacaaugacaucaagaagaaggagggcguagacagcgacuccgaguucaaguucacccuguacaaaaaugaccuccugcugauaaaagauaccgagaccaaggagcagcgccucuuccgguuccugagccgcuccaugcccaauaagaagcacuauguagagcugaagcccuacagcaaagacaaguucgagaagaacgaauccuuaaucgaaauccuagggagcgccgacaaguccgggcggugcaucaaggggcuggccaaaagcaaccuauccaucuucaaagugcgaacggacguccugggcaaccaacacaucaucaagaacgagggggacaagccgaagcuggacuucuga

SEQ ID NO: 7477 - RNA, 3408 nt, Artificial Sequence
  Cas9 variant
augggcgucaucuuccuuuacgaaaacaucguuaaacccuuccccagccgauaugauaaagcaauaaugaaacgacuaaaaggacggcaaacaaugggauacauccucagucucgacauaggaauagcaucgugcggauacaguguacuagaaacggacgcgcucggcgucccuuacaaaaucaaaacacuaaacuccaucauauucacccgagcagagaaccccaaaaccggcgccucccucgcggagccacgcagaaaguaccgcggcgccagaaggaggaaaagacgcaccagcuuucgaaagcaccgcacccgccaacucuucaucacuucaggucuucucucgaaacaagacaucgcccgcuaucuuaaccaacaagaaccccacgacgacaucugggaacuacgcgucaagggucucgacgaaccgcugacaaaccuacaacucuuccagguacucuacuauuucgucacccacaggggcuucaaaagcaacaggaaagcagaacuaaaagauaaagacaucggccccguacuaaacuccaucaacgcauucaaggaagagaugcagucacacgacuaccgcacuaucggagaauuauacgcgaacgacccacgauuccgcgaccgcaagcauaacaaagacuacacgaacgguuuccucgguacaauacagcgcagcuggcucguagacgaaauaaaaaugcugcuaacaaaccaacagagcuucgggaacacacagcuuaccagcgaguucaucgaacuauaccuaaacauauucaccucucagcgcaacuucgaugacgggcccgcaaguggucccuacuccggagaccugauagauaaaauggucggcccagacaccuucaaccgcucccgaaaacgggccccacgcgcgaccuacacauuccaauacuucagcuucuuguccaaacucaacagccuccgaaucgcacccagcaucuccgccccuuucgaaacccucacagucgaccaacgcgcccuaaucacaaaaagacuauggggaccugacgugaaaagcgcagaccucaaauucaaacagaucagaaugguucuaucccuaccggaaacagccagauucaaccuggucaacuacggcaacaccccugagaaggcauuagagaucgaagacaagacaaccuucaucuccauaaaaccucuacgcgaaauagaaaaggcacuaaccggcaccacacuccccguaucccacgaucaacuagaugccaucgcacgcauacuaaccguauacaaaagcgauucuaaccgaaagaccgcauuccacaaccagacaguacuaagugaugagguaaucgaacaacugcuaccccucaauuucucgaaauucggccacuuauccgucgaaaccaugcaagaaauaauucccuaccuagaacaaggaaugguauacuccgacgcugcgacagcugcaggcuacgacuuccgcaacaaccaaaucgacauggaauacauacgagacaacguaacaaauccagucgucaggcgagccguaucagucgccaauaagcuaguaaaagccgugguccggcgauacgggaaacccgacucaauacacauagagcucgccagagaccugucucaaaacuuccaagaacgccgacaagaugaagugcggcagcagaaaaaugcccgagacaacgagaaaauagccaaacgccucgaagaacucggaauccccguuaauggaguaaacauaacgaaaaugaaacuguaugacgaacaacacggaauagaucuauacgaccuaagcaccaacgccucaauggccguaacugacaucuuuagugacgaccguuaugaaauugaccauaucaucccauacucggucuccuuugacgacucauacacaaacaaaguacucguauccgccaaggcaaaccgcgaaaaacgcgacaggaucccaauggagguauucggcaacgacucggaacgccgccgacaauucgaaaaucgaguuaacacaaacaucacaaauuuacguaagaaaaggaaccuguuaaaagaaacguucucagacgaggacaaagcgaaauggaaaucccggaacauaaaugacacccgcuaucucaaucgcauacuuaugaacuaucucagccaaaauguagaguuuaccgauguccuguccgacgcuaaacacgucaucgcccuaaacggcgccguaacugcaaaaauccgaucccgcuggggaaucaccaagguucgcgcagcaggagaccugcaccacgccguagacgccguagugauaggaugcgucaccgacgcacugauacaagcggucacccguuacgccaaauaccaagaacgccgugacaacaaagcagcagcggaacaagaccuagccgaaaacaaccccgaagaacuggacgccaaacaauucagaaagguauuuaacgauuacccacugccguggcccgaguuccgagaagaacuaaugggcagaguaaguucggaccccagucagaucauggccggccgucaauggucccacuacacagccgaggaaaucuccgagcuaaaacaacccuucgucguacgaguuccaaaccaccgcauagucggccccgccacccuugacacuguauacggacaaccaaaccccgaugacggacucauaacccagaggguacgaaucaccgaccucaaaccacagaagaacaaggacggcgaagacauaauaaaagcgggagccaacguguacgaacucgcggcagacggcggcaacaaacucguauacgaauccauacucgaugcguuacaaguagcaggaggcgacggaaagaaggcauucccuacaggccgccuccugguccgcagcccuauccaagacauacccgucgaaagaguacgaguuacuagcaaagccacccuagucguuccagugggccccaaauccguagccgcaaacggauccaugguacgaauagacguuuacaaaaccccaaagaaauacgucuucguccccaucuacguccgcgacacgguaaaagcagagcuuccagaccgcgcgguggcccccgugaaaccguacucgcaaugguaccagcuucaacccaaagaccaguuccuauucucacuauucgcaaacgaccugauaagauucaaacacccccgcggagugaguacaaaagaaauccucaccgacggcucacaggagaaagggaaaagaacagacgucgucggguacuuuacaggagccgacaucgcgacagccagcaucgcgaucgaaggcccagaccgcuccuucagcgcccgcggcaucggcuucgccuccuuaaagaaugucgaaaaacuaacagucaacuacuucggcgaacuccacagcguacacgagacacagccaaugcaguuccgcgggcaacgcggauga

SEQ ID NO: 7478 - RNA, 3411 nt, Artificial Sequence
  Cas9 variant
augaacggccuagugcucgggcuggacaucggcaucgccagcgucggggugggcauccuggagaaggacaccgggaagaucauccacgccuccagccgccucuuccccgcggccaccgcugacaacaacguggagcggcgcuccaaccggcagggccgccggcugaaccgccggaagaagcaccgcagcguccggcugcaggaccucuucgaguccuacgggcugcugacggacuucucaaagcucuccaucaaccugaacccauaccaguuacgcgugcaggggauggagaaccagcucaccaacgaggaacuguucaucgcacugaagaacauagugaagcggcgcggaaucagcuaccucgacgacgccuccgaggacgggggcaccgucagcuccgacuacgggaaggcgguggaggagaaccggcgacuguugaccgagaagacgcccggccaaauccagcucgagcgcuucgagaaguacggccagcugcgcggggacuucaccguggaggagaacggcgagaagcggcgccugaucaacgucuucagcaccagugccuaccgcaaggaggcugagcgcauccuccggaagcagcaggaguucaacaacaagauaaccgacgaguucaucgaggacuaccugacgaucuuaaccgggaagcgcaaguacuaccacggccccggcaacgagaagucccgcaccgacuacgggcgguuucgcaccgacggcacuacccucgacaacaucuucgggauccugaucggcaagugcaccuucuaccccgaggaguaccgggccagcaaggcgagcuacaccgcccaggaguucaaccugcucaacgaccugaacaaccugacggugccgaccgagaccaagaagcucuccgaggagcagaagaagacuaucaucgaguacgccaagagcgccaagacgcugggggccuccacccugcucaaguacaucgcgaagaugaucgacgccagcguggaccaaauccgcggcuaccgggucgacgugaacaacaagcccgagaugcacaccuucgagguauaccgcaagaugcagagcuuggagaccaucaaggucgaggagcugccccggaaaguucucgacgagcuggcccacauccugacgcucaacaccgagcgcgagggcaucgaggaagccaucaacuccaagcucaaggacaccuucaaccgggaccaggugcuggagcucguccaguuccgcaagaacaacagcucacuguucagcaagggguggcacaacuucucccugaagcucaugauggagcugauccccgagcuguacgagaccagcgaggagcagaugacgaucuuaacccggcugggcaagcagcgcuccaaggagaccagcaagcggaccaaguacaucgacgagaaggaguuaacggaggagaucuacaacccggugguggccaaguccguccgccaggcuaucaagaucaucaacgaggccaccaagaaguacgggaucuucgacaacaucgugaucgagauggcccgggagaacaacgaggaggacgccaagaagaacuacaucaagcagcagaaggccaaccaggacgagaagaacgccgccauggagaaggccgccuuccaguacaacggcaagaaggagcuccccgacaacaucuuucacgggcacauggagcucgccaccaagauccgccuguggcaccagcagggcgagaagugccuguacaccggaaagaacauccagaucagcgaccucauccacaaucaguacaaguaugagaucgaccacauccugccccugucccucagcuucgacgacucccugagcaacaaggugcucguccucgcgacggccaaccaggagaaggggcagcggacccccuuccaggcccuggauuccauggacgacgcauggagcuaccgcgaguucaaauccuacgugaaggagagcaagcugcucggcaacaagaagaaggacuaccugcugacggaggaggacaucuccaagaucgaggucaagcagaaguucaucgagaagaaccucguggacacccgguacagcagccgcgugguccugaacgcgcugcaggacuucuacaagaagcaucaguucgacaccacgaucuccguggugcgcgggcaguucaccagccagcuccggcgcaaguggaagcuggagaagucccgggacaccuaccaccaccacgccgucgacgcccugaucaucgccgccagcucccaacuccgccuguggaagaagcacaacaacccgcugaucagcuacaaggacggccaguucguggacucugaaaccggggagaucgugagccucuccaacgaggaguauaaggagcuggucuucaaggcgcccuacgaccacuucguggacacgcugcggagcaagaaguucgaggacuccauccucuuuagcuaucagguggacuccaaguacaaccgcaagaucagcgacgccaccaucuacgccacccggaaggccaagcuggacaaggacaagaaggaguacaccuacacgcugggcaagaucaaggacaucuacgcccucggcaccaagacccccuccaagaccggguucuacaaguuccuggaccuguacaagacggacaagagccaguuccucauguaccagaaggaccgcaagaccugggacgagguaaucgagaagaucaucgaacaguaccggcccuuuaaggaauacgacaagaacggcaaggagguggacuucaacccguucgagaaguaccgcaucgagaacgggcccauccggaaauacucccggaagggcaacggcagcgugaucaagagcaugaaguacuacgacaaccuccuggggaaguucgucgacaucacccccuccgagagcaagaaccccguggcgcucuuguccuugaacccguggcgaaccgacguguacuacaaccccgagacgcgcaaguacgaguuccucggccugaaguacgccgaccugugcuucgggaagggcgggagcuacggcaucuccgaggucaaguacaacaagauccgggagaaggagggcaucgggaaggagagcgaguucaaguucacccucuacaagaacgaccugauccuaaucaaggacaccgaaacaaacugccagcaguucuuccgauucuggucccggacgggcaaggacaaccccaagagcuucgagaagcacaagaucgagcucaagcccuacgagaaggccaaguucgagaagggggaggagcuggaggugcugggcaaggugccgcccucaagcaaccaguuccagaagaacaugcagaucgagaaccucuccaucuacaaggucaagaccgacgugcuggggaacaagcacuucaucaagaaggagggcgacgagcccaagcugaaguucaagaaguga

SEQ ID NO: 7479 - RNA, 3411 nt, Artificial Sequence
  Cas9 variant
augaacggccuggugcucgggcuggacaucggcaucgccagcgucggggugggcauccugaagaaggacaccggggagaucauccacaccaacucccgccucuucagcgccgcgacggccgacuccaacaucgagcggcgccggcaccgcggaggcaagcggcugacccgccggaaaaagcaccgcagcauccggcugcacgaccucuucgaggacuccgggcugcugaccgacuucagcaagguguccauaaaccucaaccccuaccagcugcgcguccagggccuggacaaccagcucaccaacgaggagcuguucaucgcccugaagaacauugugaagcggcgcgggaucucauaccucgacgacgccuccgaggacggcgggacggugagcuccgauuacggcaaggccgucgaggagaaccggaagcugcuggcggagcagaccccgggccagauccagcucgaccgcuucgagaaguacgggcagguccggggcgacuucaccgugguggagaacggggagaagcgccggcugaucaacguguucacaacaagcgccuacuccaaggaggccgagcgcauccugcggaagcagcaggaguucaacaagaagaucacugacgaguucauugagaacuaccucaccauuuuaaccggcaaacgcaaguacuaccacggccccgggaacgagaagucccggacggauuacggccgcuacaccaccaagaaggaccccgaagggaaguauaucacccuggacaacaucuucggcaucuugaucgggaagugcacguucuaccccgacgaguaccgcgccagcaaagcgagcuacaccgcccaggaguucaaccugcugaacgaccucaacaaccugaccgugccgacggagacaaagaagcuguccgaggagcagaagaagaccaucaucaaguacgccaagaccgccaagacccucggggccagcacgcugcugaaauacaucgcgaagcucaucggcgccuccgucgaccagauccacggguaccggaucgaccccaacaagaagcccgagaugcacaccuucgagaccuaccgcaagaugcagagccuggagaccaucagcguggaggaaaucccccggaaggugcuggaugagcucgcccacauccugacgcucaacaccgagcgcgaggggaucgaggaggcuaucaacgccacacucaaggauaccuucucccaggaccagguucuggagcuggugcaguuccggaagaacaacagcagucucuucagcaagggguggcacaacuucucccugaagcugaugauggagcucaucccggagcuguacgagacgagcgaggaacagaugacuauccugacccgccucggcaagcagaaguccaaggagaccagcaagcggacgaaguacaucgacgagaaggaacugaccgaggagaucuacaaccccguggucgcgaaguccgugcgccaggccaucaagaucaucaacgaagccaccaagaaguacgggaucuucgacaacaucgugaucgagauggcccgggagaacaacgaggaggacgccaagaagggcuacaacgagcgccagaaggcgaaccuggaugagaagaaguccgccauggagaaggccgccuuccaguacaacggcaaaaaggagcugcccgacaacguuuuccauggucacaaggagcucgccaccaagauacggcuguggcaccagcagggcgagaagugccuguacaccgggaagaacauccccaucagcgaccucauccagaaccaguacaaguacgagaucgaccacauccugccgcugagccucuccuucgacgacagcuuauccaacaaggugcuggugcucgcaacggccaaucaggagaagggccagcgcacccccuuccaggcccuggacagcauggacgacgccugguccuaccgggaguucaagagcuaugucaaggaccugaagcuccugagcaacaagaagaaggacuaccugcucaccgaggaggacaucagcaagaucgaggugaagcagaaguucaucgagcgcaaccuggucgacacccgguacagcucccgcguggugcugaacgcgcuccaagacuucuacaaggagcaccaguucgauacgaccaucagcgucgugcgugggcaguucaccucccaacugcgccggaaguggggccuggagaagucccgcgagaccuaccaccaccacgccguggacgcccucaucaucgccgccagcagccaacugcgccuguggaagaagcagaacaacccccucaucuccuacaaggagggccaguucgucgaccaggagacgggggagaucaucagccuguccgacgacgaauauaaggagcugguguucaaggcgcccuacgaccacuucguggacacccucaagagcaaaaaguuugaggauuccauccuuuucagcuaccaggucgacuccaaguacaaccggaagauuagcgacgccaccaucuacgccacccgcaaggccaagcuggacaaggagaagaaggaguacacguacacccucggcaagaucaaggacaucuacgcccugggguccgagaagcugaagaccggcuucuacaaguuccuccaccuguacaagaaggacaagagccaguuccugauguaccagaaggaccggaagaccugggacgaggugaucgagaagauccucgagcaauacagaccauucaaggagaaggacaagaacggcaaggagguggacuucaaucccuucgagaaguaccggaucgagaaugggcccauccacaaguacucccgcaagggcaacgggcccgucaucaagagccugaaguacuacgacaagaacaucccggagagcuucaucaacaucacccccuccaacagcaagaacaaggugauccugcggcagcucaaccccuggcgcaccgacguguacuucaaccaccagaccgagaaguacgagcugcugggccucaaguacgcgcaccuccaguucgagaagaagaccgggaacuacucaaucacgaucgacaaauauaacgagaucaaggagaaggagggcguaagcgaacaguccgaguucaaguucacccugcacaagaacgaccuacugcugauaaaggacaccgagaccaaggagcagcagcuguuccguuuccugagccgcacgaagcccaacgugaagcacuacguggagcugaagccuuacucccgggacgaguucgaaaagaacgagcgccucaucgagauccugggcagcgucgacaaguccgggcgguucgugaagggccugggcaagagcaaccucuccaucuacaaggugcgcaccgacguccuggggaaucagcacauuaucaagaaggagggggaggagccuaagcugaaguucuga

SEQ ID NO: 7480 - RNA, 3411 nt, Artificial Sequence
  Cas9 variant
augaacggccuggugcucgggcuggacaucggcaucgccucggucggggugggcauacuggagaaggacaccgggaagaucauccacgcauccagccgccucuucccggcugccacggccgauaacaacguggagcgccgcuccaaccggcagggccgccggcuaaaccgccggaagaagcaccgcucaguccggcugcaggaccucuucgagggcuacgggcugcuaacggacuucuccaaggugagcaugaaccucaacccguaccaacugcgcgugcagggcauggagaaccagcuaacuaacgaggaacuguucgucgcccucaaaaacaucgugaagcggcgcgggaucuccuaucuggaugacgccagcgaagacggagggaccguguccagcgacuacggaaaggcgguagaggagaaccggaaauuacuggccgagaagacccccggacaaauacagcuggagcgcuucgaaaaauacgggcagcuccggggcgacuucacgguggaagaaaacggggagaagcaucgcuuaaucaacguuuucuccaccagcgccuaccggaaggaggccgagagaauuuuacggaagcagcaagaguucaacuccaagaucaccgacgaguucaucgaggacuaccucaucauccugaccggcaagcgcaaguacuaccaugggcccgggaacgaaaagucccggacggacuacggccgcuuccgcacugacgggacuaccuuagacaacaucuucggcauccucaucggcaagugcacguucuacacagaggaguaccgggcaaguaaggccagcuacaccgcccaggaguucaaccugcugaaugacuuaaacaaccugaccgucccaacggagaccaagaagcuguccgaggagcagaaaaagcucauuauugaguacgccaagagcgccaagacccugggcgcguccacccugcucaaguacaucgccaagaugaucgacgccagcguggaccagauccgcggcuacaggguggacgucaacaacaagccggaaaugcacacguuugagguguaccgcaagaugcaaagccuggagaccauuaaaguggaggagcugccccggaagguccucgacgagcuggcccacauccugacguuaaacaccgagcgcgaagggaucgaggaggccaucaacuccaagcugaaggacaucuucaaccgugaccaggugcuugagcucgugcaguuccguaaaaauaacagcucccuguucagcaagggcuggcacaacuucuccaucaaguugaugauggagcuaauccccgagcuguacgagaccagcgaggagcagaugaccauccugacacggcucgggaaacagcgcucuaaggagaccuccaagcggacgaaguacaucgacgagaaggagcugaccgaggagaucuacaaccccgucguagccaaguccgugcgccaggccaucaaaaucaucaacgaggcaacgaagaaguacggcaucuuugacaacaucgugaucgagauggccagggaaaacaacgaggaggacgccaagaaagauuacaucaagcggcagaaggcgaaccaggacgagaagaaugcggcuauggagaaagccgccuuucaguacaacgggaagaaggaacugccggacaacauuuuccacggacacaaggagcugaccacgaagauccggcucuggcaccagcagggcgagaagugccuguacaccgggaagaacauacccaucucggaucugauccacaaccaguauaaguacgagauugaucacauucucccccugucccugagcuucgacgacucccucagcaacaaggugcuagugcuggcgacagccaaccaggagaagggucaacgcacccccuuccaggcccuugacuccauggacgaugcauggagcuaccgcgaguucaaguccuacgugaaggacagcaagcugcuuuccaacaagaagaaggacuaccuccugacggaggaggacaucagcaagaucgaggugaaacagaaauucauugagcgcaaccuggucgauacacgcuacagcucccgcguggugcucaacgcguugcaggacuucuacaaaucucaccagcuagacaccacaaucuccguuguuaggggucaguucaccagccagcugcggcgcaaguggggcaucgagaagucccgggagacguaccaccaucacgccguugacgcccugaucauugccgccagcucacagcugcgccucuggaagaagcacagcaacccgcugaucgcguacaaggaggggcaauuugucgacucugagaccggcgagauugugagccuguccgacgaggaauacaaggagcucguguucaaggccccauacgaucacuucgucgacacccugcggagcaagaaguucgaggacuccauccuguucagcuaccagguggacuccaaauacaaccgcaagaucagcgacgcgaccaucuacgccacgcggaaggccaagcucgauaaggagaagaaagaguacaccuacacccugggcaagauaaaggacaucuacgcgcuggguacuaagacgcccuccaagacuggcuucuacaaguuccucgaccuguacaagacugacaagagccaguucuuaauguaccagaaggaccguaagacgugggaugaggucaucgagaagauaaucgagcaguaccggcccuucaaggaguacgacaagaacgggaaagaggucgacuucaacccguuugagaaguaucgcauaggcaauggccccauccggaaguacagcaagaaggggaauggccccgagaucaagucacucaaauacuacgacauccugcuugggaaacacaaaaacauuacgcccgauggaagccgcaacaccguggcccuguugucccugaacccuuggcggaccgacguguacuacaacagcgagaccaaaaaguacgaguuccuugggcugaaguacgccgaccugugcuucgaggagggcggcgcuuaugggaucagcgaggucaaguacaagaagauacgcgagaaggaggggaucgggaagaacagcgaguucaaguucacacuuuacaagaacgaccugauacugauaaaggacaccgagaccaacugccagcaguucuuccguuucuggucccgaacaggcaaggauaacccuaagagcuucgagaagcacaagaucgagcucaaacccuacgaaaaggccaaguuugagaagggggaggagcucaagguguuaggcaaggugcccccuuccagcaaccaguuccagaagaacaugcagaucgagaaccucuccaucuacaaaguaaagacggacauccuaggcaauaagcacuucaucaagaaagagggggacgagcccaagcugaaauucaagaaguga

SEQ ID NO: 7481 - RNA, 3420 nt, Artificial Sequence
  Cas9 variant
augagcgaccuggugcucggccuggacaucgggaucggcuccgucggggugggcauccugaacaaggugaccggggagaucauccacaagaauagccgcaucuuccccgccgcccaggcggaaaacaaccucgagcggcgcaccaaccggcagggccgccggcugacgcgccggaagaagcaccgccgaguacgccugaaccaucucuucgaggaauccggccugaucaccgacuucaccaaggugagcaucaaccugaaccccuaccagcuccgggugaaggggcugaccgccgagcuguccaacgaggagcuguucaucgcccugaagaacauggucaagcaccgcggcaucagcuaccuggacgaugccuccgacgacgggaauagcuccgugggcgacuacgcccagaucgugaaggagaacagcaagcagcucgagacgaagacccccgggcagauccagcuggagcguuaccagaaguacggccagcugcgcggcgacuucaccgucgaggaggacgggcguaagcaccgccucaucaacguguuccccaccagcgcguaccacgccgaggcccuacggauccugcagacgcagcaggaguucaacccacagaucaccgacgaguucaucaacagcuaccucgagauccugaccggcaagcgcaaguacuaccacgggccgggcaacgagaagucccggaccgacuacggcaaguacacgaccaagaaggacgcccaggggcaguacaucacccugaacaacaucuucggcauccucaucgggaaguguaccuucuaucccgaggaguaccgggcggccaaggccagcuacacggcgcaggaguucaaccugcugaacgaccucaacaaccugaccguacccaccgagaccaagaagcuguccgaggagcagaaguaccagaucaucacguacgucaagaacgagaaggccaugggccccgcgaagcuguucaaguacaucgccaagcuacuuuccugcgacguggccgacaucaagggguaccggaucgacaaguccgacaaggccgagauccacaccuucgaggccuaccgcaagaugaagacccucgagacccuggacgugaagaagauggcgcgcgaggagcuggacaagcucgccuacguccugacgcugaacaccgagcgggagggcauccaggaggcccucgaccacgaguucgccgacggcaccuucagccaggagcaggucgacgagcuggugcaguuccgcaaggccaacuccagcaucuucgggaagggcuggcacagcuucuccgugaagcugaugauggagcucaucccggaacuguacgcgaccagcgaggagcagaugacgaucuugacccggcucgggaagcagaagaccaccuccagcuccaacaagacgaaguacaucgacgagaagcagcugaccgaggagaucuacaaccccgugguggccaaguccguccgccaggccaucaagaucgugaacgccgccaucaagaaguacggcgacuucgacaacaucgugaucgagauggcgcgggagaccaaugaggacgacgagaagaaggccauccagaagauccagaaagccaacaaggccgagaaggacgcggccaugcgcaaggccgccaaccaguacaacgggaaggccgagcugccccacuccgucuuccacggccacaagcagcucgcgaccaagauccggcuguggcaccaacagggcgagcgcugccuguacacggggaagacuaucagcauccacgaccugaucaacaaccccaaccaguucgagaucgaccacauccucccgcuguccaucaccuucgacgacagccuggcuaacaaggugcucgucuacgcaaccgccaaccaggagaagggccagagaacccccuaccaggcccuggacuccauggacgacgcguggagcuuccgcgagcugaaggccuucgugcgggagucgaaggcccucagcaauaagaaaaaggaguaccugcugacggaggaggacaucuccaaguucgacgugcgcaagaaguucaucgagcggaaucucgucgacacccgcuaugccagccggguggugcugaacgcccugcaggagcacuuccgcacccacaagaucgacaccaaggucuccguggugcgggggcaguucacgagccagcuccgccgccacuggggcaucgagaagacccgcgacaccuaccaccaccacgcggucgacgcccugaucaucgcggccuccagccagcugaaccucuggaagaagcagaaaaacacccuggugucuuacucggaggaccagcugcucgauaucgagacgggggaacugaucagcgacgacgaguacaaggaguccguguucaaggcgccauaucaacacuucgucgacacccucaagagcaaggaguucgaggacuccauccucuuuagcuaccagguggacuccaaguucaaccgcaagaucagcgacgccaccaucuacgccacucggaaggcuaagcuggacaaggagaagaaggaguacacguacacccugggcaagaucaaagacaucuacgcccucggcaccaaaacccccuccaagacgggguucuacaaguuccuggaccuguacaagaaggacaagagccaguucuuaauguaucagaaggaccgccggaccugggacgaggugaucgagaagauccuggagcaguaucgcccguucaaggagaaggacaagaacggcaaggaggucgacuucaaccccuucgagaaguaccggaucgaaaacgggcccauccgcaaguacucccggaaggguaacggccccgagaucaagagccugaaguacuacgacaaccuccugggccgcuucguggacaucaccccguccgagagcaagaaccccguggcgcugcucucccugaaccccuggcggaccgacgucuacuacaacacggagacccgcaaguacgaguuccugggccucaaguacgccgaccugugcuucgagaaaggcgguagcuacgggaucuccaaggugaaguacaacaagauccgggagaaggagggcaucggcaagaacagcgaguucaaauuuacccuguacaagaacgaccucauccugaucaaggacaccgagacgaaccgccagcagauauuccgguucuggagccgcaccgggaaggauaaccccaaguccuucgagaagcacaagcuggagcucaagccguacgagaagacccgguucgagaagggcgaggagcugaaggugcuggggaaggucccgcccagcuccaaccgccuccagaagaacaugcagauugagaaucugagcaucuacaaggugcggaccgacgugcugggcaaccagcauaucaucaagaacgagggggacaagcccaagcucgacuucuga

SEQ ID NO: 7482 - RNA, 3420 nt, Artificial Sequence
  Cas9 variant
augaacuacuauaacggauucaucauaaccgaaaacgcaauggcgagcaaacacgaaaaccucggcgcacucacauucggccuggacauagguaucgcaucuguaggcugggcagugcuaggggaaaaccgcauaaucgaccuuggcguccgguguuucgacaaagccgaaaccgccaaagaaggagaaucccucaaccuagcccggagaacggcccgacugcucagacggcgguuacgacgacgagcauggagacugacgaaacuggcgcgccuucuaaaaagagagggacuuaucgccgacaccaacgucuuccagaaacccuucaaccucaaggacgcaaacgagaaaggguuaucauucuggcaacuacgcguggacgcacuggacagaaaacuuucagccgaagagugggcacgugucauauaccacuuaugcaaacaccggggauuccacuggaucucgcgcgccgaagagaaagccgcggagggcgacaguaaaagugaaggaggaaagguaaagcagggccuggccggaacgaagaaacugaugcaagagaaaaacuaccgcacagcagccgaaaugguccuaacugaguucccggaagcccagagaaauaaacaaggagauuacuccaaagcacuaucgcggauucuacuaggcgacgaaaugacacaacuauucaaacaccaaagggaacuaggcaacccccacgcgaccgaaaaacuagaagccgcgauauuaggcaauggggaccacaaaagcggacucuucugggcgcaaaaccccgcccuggccggaaacgaccuucucaaaaugcucggacacugcaccuucgaaaaggcagaauaccgcgucccaaaagccagcuucacagcggaaaggcacgucuggcuaacgcgacuaaacaacuuaagaaucguagucgacggaacgacccgaccucuuaacgaagcggagagacacuuggcacuccucaugcccuaccaacaggcaggagaucucacguacaaacaacuccgcaccgcacuaacaaaagcaggauaccucccagagagcuuccgcuacacagggcuggcauaugccagcggccaaaaagcggacgaaaaagcaaaagaucccgaaagugcaccccuaguuaagcucccggcguggcacgaacuacgaaaaacccucgaaaagaaagaacucgcaucggaguggcagaaaaucuccucagacgcccuagacggcaaaccccaacuacuagaccaaauagccugggucuugagcguauacaaagacgacaccgaggucgaagcggaacucugcaaacucaaucuaccgaacgcagagaaaaugaucgacgcccuccuagacauccgauucgacaaauucagcaaccugagcuuaaaagcccuccgccaaaucgucccccugauggaacagggccagcgcuacgacgaagcgguagcaaacauacccgaauacggucaccacagccagcugcacgaaguaggagccggagaacacaaauaccucccaccauucuauaaagaacgcgacaaaaccggucgaauggucuucaacgacgacauggacauaccgcgcaaccccgucguauuacgagcccugaaccaagcacgcaaggucguaaaugcccucauuaaagaguauggaagcccccacgaaguccacauagaaauggcgcgcgaucuaagccgaccacuugacgaaagaagggacguagagaaacugcaaaaagaguuccgagaccgcaacgaaaaggacaaagcccuauucgcacaggacuucaacauaguaggcgcuguaaaaggcaaagaguucgaaaaauaccaacucuaccgagaacaacaagguaagugugcuuacagcaucgaacccauggacauacacagacucuucgagcagggguauguggagauagaccaugcgcuaccauauucacgcagcuucgacgacagcaaaaacaauagaguccuuguauuagcaaaggaaaacagggacaaagggaacaggaccccauucgaauaccuuggcggaaaagacaacucagagcgguggagacaauucguagcguucguagaaggaaacaaauccuaccggcucgccaaacgaucgcguuugcucaggaaggacuucggaaaagacgaagcaaaaggcuucagggaaagaaaccuaaacgacaccagguacauaugccguuucuucaaaaacuacguggaacaauaccuacaauugcacgaagacuccgacgccaagcggugcgucguacuauccgggcaaaugaccucauucuuaagagcaagguggggccucguaaaagucaggggcgauucagaccgacaccacgcacuugacggagccauaguggccgcaugcagccacuccaugguaaaacgccucagcgacuacagccggcgaaaagaacucgaacaaguccgagcaggguucguugacgucgacaccggcgagaucgucaaccccgcuauguuucagcaagugcaagaacacuuuccaaacccauggccacacuucagggacgaaguaaaacugcgccugaacgucgacgacccagcgcuccuccauuccgaaaugaaccgcuucgggaccuacagccccgaggcccucaaagcgcuccgaccccuauuuaucagcagagcaccccagcgucggaauagcggagccgcccacaaggacacaauuuacgcucaacccgaacgccuagucgcccaaggcggcgugacccagaaaguaccccuaaccucacuaacccuaaaggaccucgauaaacucauagacccccaccgcaacgaaaaacuauacucagcaauaaggauccgccuagagcaacauggaggcaaaggcgacaaggccuuccccgccagcaacccauuacgaaaaccagacucggaaggcaacccaaccggccccaucguacgcgguguaacaaugguaaucgacaagcucucgggaauaccaauaaggggcggcaucgccaaaaacgauucaaugguaaggguagacguauucaccaaggccggcaaauuccaucuagucccuguauacguccaccacgccguagcaaaagugcugccgaauagagcuguaguagcguacaaggacgaaaccgaauggacacuaaucgacgacggauuugacuucugcuuuucaauguacccgaacgaccugcugagaauaaagcuaaggaacgccucgcaccugggauacuaugccuccugcaaucgcuccacgggagcgaucaaccuauggucacacgaccgaaaccaacaagucggaaaagacggaaugauagaaagcaucggcgucaagacugcacucaaugucgaaaaacuaaauauagauguacuaggcaaccgauacccugcaccuccagagaaaagacgugaccuagcauga

SEQ ID NO: 7483 - RNA, 3423 nt, Artificial Sequence
  Cas9 variant
augaagaacaugacgaaagucaacgucggccuggacguggggaucagcuccgccggcuggagcguuaucaacgccgagacuaaccagauccucgaguccggcguccgccuauuuagcggcuccgacgccgacgaaaacgugaaccggcgcaaucagcggcagggucgccggcuguucagacggcgcaagcugcggauccaggaggccaaaaaguaccuggaaaacguguuucagcugaaagauaucgagcccaaggacgaguggaacccguacgagauucgcgugcgggcccucaacgagaaggugagcaaggaggaacuguccaucgcccugcucaacauugugaagcaccgcgguaucagcuacgaacuggaggaugucaccgacgaggagggcacuaacacccagucauuccagagcgggcuggacuacaaccggcgccuccugaagaccaagacugugggcgagauacaguacgaccggcugcaaaaguaugggcaagugcgcgggcagauccagaccgaggacggguugcugaucaacaucuuccccaccaaaaacuacgucgaggaaguggagaggauccuggaaacccagaagaaguaucaccccgagaucgacgacguauucaucgagaagaucaucuccuucgugacgagaaagcgugaguacuucguuggccccggcaacgaaaagagccggacagacuacgggaucuaccgggaaaacggcgagaccuuggacaaccuuuucgaaauccugaucgggaaggauaaguucuacccggaagaguaccgcgccgcgggcagcuccuacaccgcccagaucuucaaucuccugaacgaccugaauaaccuccgcauccccacgaccgaggaccaccaccugaccaaggcccagaaggaggagaucaucaccgaguuaaagaacacgucccggcucagcggcggaaugcuaaagcugaucuccaaggugaccaaggcccccaaggaggagaucaguggcuaccggaaagacgagaaggacaagcccgaccuucauucccuggcguacuaccggaaacaaaagaacaugcuggagaaggaggguauccagaucgccgacuucagcgaggagcuccuggacgagcuggccaccaugaugaccuuaaacacggagccaggagaaauacgcaagcagcugaacaagaucaccaaccaguacgacauccucaccccugaagucaucgaggugcucguuaagaaccauacggccuucgucgcaacgagcaaccacaaguggcaccgguucucccugaagcugaugaaggaguucauccccgagcuccuggagaccucgaaggagcaauccaccauccugugcgaacgcggguucauccagaaccgggcgagcuaucucgacgagaaccaucacuucaacuacgccgagcuacgcgagaaccuguacaacccgguggugcggaaguccacgugcgaaaugcucaaggucuucaccgccauacaggagaaauacccgaacauccagaacgugaucgucgagcugcccagagagacuaacgaggacgagcagaagcggaagaucaagaagauuaacgacaacaacgccaagcgcaagaaggagaucuugaaggaggcucaggcgcaaagcggccuguccgaggaggcccucgaagagaagcugcugaagaccaaaggacucuaccugaagcugaugcucugguacgagcaggaggggaagugcguguacagcgggcaagagauaccgcuguccgaccuccuccagaauaaaggcggguacgagguggaucacaucaucccuaucagcaucuccuucgacgaccggcugugcaacaagguccugguucgccagcagcucaacagccagaaauccaaccaaaccccguucgaguacaugacaacccauaccgaugggcaccugagcuuucacgagcugaaggagcucgugggcaagaacaagcgguucuccaaggagaagcgcgagcugcuucucgccgagaucuacagcaacgacaucgagacccggaaacgcuucaucaaccggaaccuggucgacacgucauacaccgcccgcaucgugcuuaacgcccuccagcaguacaagaaggagaaccagcugagcaugaacgugagcgucgugcgcggcgcgaugaccaacauccugcgaaagaaggugaagcucgacaaaacccgcgagaccuuccaccaccacgccaucgacgccagccugauggccgucauccccaacaucgaguucuucaaggagcggaaggaguggcuacccaaaucugccaacgaggaagugguugaggucgaggucuccgaggaggaaacgaugccugagaaggaguuuaaagugaagaugcgccucccggagagcuucauccaggacguccagaucuugcagagaaacuccuucgcuaaggaggaagugucgggcccccagacccgcgagcggaacuuaaagaucaaguucagucaccagguggaccagaagaugaaccgcaaggucgccgacgacaccauauacggcacccggcaggcucaguuagggaaagacaagaaggaggagacguacgugauuggcaagaucaaggacaucuacaacuacgacgaauacgugcgcuucaagaagcgguacgacaagaacaaggagagcuuccuuauguaccaccacgacccccagaccuucgaaaagcuggaggagaucuuggcccaauaucccgaguauaucgaggacgagaaggggaaaaagaagaaggucuccccguucgcgcuuuaccgcgaggagaacggccccguaaccaaauacgccaagaagaacaauggccccgugaucaagcagcugaaguacuacgacagcaagcucaaucggaagaucgacauaucccacaaguacagcaccaaaaaccgccaggucgugcuacagucccugaaacccuaccgaacggacguguacagaaaccaggacaccggggaguacacccucgucggcaucgaccagaacgacgggaaauucgugaacggccacuacggcauccccaagagccgguacgaagagaucaaggccaacaacaagcuguccgagcacgacgaguucguguucagcuuauauaagaacuccauggucaaggucaucgacgagaacggggagagcaucgugguccgcuaccucagccggucaaugccuaaccgcaagaacaacgccgagaucaagcccguggagaaguaccaguucgaagacggcgagguggucccgguguaugggaagugccggaagcagaugcagaccgucuucgucaagaagggcuggacgcugcugaaggggaacaccgacauucucggcaacaccuacuucguggagaaggagagcgagaaccccaagaagaugaucgacgacaaguga

SEQ ID NO: 7484 - RNA, 3423 nt, Artificial Sequence
  Cas9 variant
augagagaaaacggauccgacgaacgcaggcgaaacauggacgagaaaauggauuacaggaucggccuggacauaggaauagcaagcgucggaugggccguccuccaaaacaacagcgacgacgaacccgugaggaucgucgaucugggcguacgaauauucgacaccgcagaaauaccaaaaaccggcgaaagccuggccgggccucggcgcgcagccagaacaacucgccgucgcuugcgacggcguaagcacaggcuagaccgaaucaaauggcuauuugaaaaucaaggucuaauuaauaucgacgacuuccuaaaaagguacaacauggcgggacucccggacguauaccaacugcgcuaugaagcacucgaccgcaaacuaaccgacgaggaacucgcacaaguucugcugcacaucgcaaaacaucgaggcuucagaucgacgcggaaagcagagaccgcggccaaagaaaacggcgcgguacuaaaagcaacagacgaaaaccaaaagagaaugcaggaaaagggauaccgcaccgucggcgaaaugaucuaccucgacgaagcguuccgcacuggcugcucuuggagcgaaaaaggauacauacucacaccacgcaacaaagcagaaaacuaccaacacacaaugcuaagagcgaugcuggucgaagaagucaaagagaucuucucaagucagcgccgacuggggaacgagaaagcaaccgaagaacuagaagaaaaauaccucgaaaucaugaccucccaaagaucauucgaccucgggccaggcaugcagcccgacggaaaacccagcccauacgccauggagggauucagcgaccgaguagggaagugcacguuccucggcgaccaaggagaacugagaggggccaaagggacauacacagccgaauacuucguggcgcuccagaaaaucaaccacacgaaacuugucaaucaagacggggaaacgcggaacuucacagaagaggaacgccgcgcacuuacacuacugcuguucacccaaaaagaggugaaguacgcagcagucagaaagaaacuaggccucccagaggacauccuuuucuacaaccugaacuacaagaaagcggcgacaaaagaggaacagcaaaaagaaaaucaaaacacagagaaagcgaaauuuauaggcaugcccuacuaucacgauuacaagaaaugccuagaagaaagagucaaguauuugaccgagaacgagguccgcgacuuauucgacgagauuggaaugauccucacaugcuacaaaaacgacgacagccgaacagagcgacucgcaaaacuagggcucgugccuauagagauggaaggccuauuagcauacacaccaaccaaauuccagcaccugagcaugaaagcaaugcgcaacaucauccccuuccucgaaaaggguaugacguacgacaaggcaugcgaggaagcgggcuacgacuucaaggcggacucgaaaggcacaaaacaaaaacuacucacaggagagaaugugaaccaaacaauaaacgaaaucaccaacccaguaguaaaacggagcguaagccagaccgucaaagucauaaacgcaaucauccgcacauacggcagcccacaagccauuaacaucgaacuagcccgcgagaugucaaaaaccuucgaggagagacgcaagaucaaaggagacauggagaaacgacagaagaacaacgaagacguaaagaaacaaauacaagaacucggcaaguuaucccccacagggcaagacauccuaaaauaccgacuuuggcaggaacaacagggaaucugcauguacagcggaaagacaaucccccuggaggaacuuuucaaaccgggguacgacauugaccacauccuaccguacagcaucacauucgacgauucauucagaaacaaagugcuaguaacaucccaagagaacagacaaaaagguaacagaacucccuacgaauacaugggcaacgacgaacaacgauggaacgaguucgaaacacgggugaaaaccacgauacgagacuacaagaagcaacagaaacugcucaagaaacacuuuucggaagaagaaaggucagaguucaaagaaagaaauuugacagacacgaaauauauaacaacagucaucuacaacaugauaaggcaaaaccuagaaauggccccgcugaaccgucccgaaaagaagaaacaaguccgagcaguaaacggcgcaauaacagcguaccugaggaaacgcuggggacuuccccagaaaaaccgggaaacggauacgcaucacgccauggacgcagugguaaucgccugcugcaccgacggcaugauacaaaagaucucgagauacaccaaaguacgugaacgcugcuacucaaagggcaccgaguucgucgaugcagaaacgggcgaaaucuuccguccagaagacuacucgcgagcagaaugggacgaaauauucggaguacacauccccaaaccaugggagacuuuuagagccgagcucgacgucagaaugggagacgacccaaaaggauuccucgacacgcacagcgacguggcccucgaacucgacuaccccgaguacaucuacgaaaaucuucgacccaucuucguaagccgaaugccgaaccauaaagugacuggagcagcgcacgccgacacaauccgaaguccccggcacuucaaagacgaaggcauagucuuaacaaagaccgcgcucacagaccucaaacuggacaaggacggggagaucgacggauacuacaauccacaaagugaccuccuacucuacgaagcacucaagaaacaacuccuccuguacggcaaugacgcaaagaaagccuucgcgcaagacuuccacaaacccaaagcagacggcaccgagggaccaguuguccggaaaguaaagauccaaaagaaacaaaccaugggagucuucguggacagcggaaacgggauagcagaaaacggcggaaugguaagaaucgacguauuccgcgucaacgggaaauauuacuucgugccaguguacaccgcagacguugugaagaaaguucugccaaaccgcgcuagcacagcacacaaaccauacggggaauggaaaguaauggaagacaaagacuuccuauucagccuauacucacgcgaccuaauacacauaaaaagcaagaaagacauacccauaaaaauggucaaugggggaauggaaggcauaaaagagaccuacgcauacuacauaggagcggacaucucagcggccaacauccaaggcaucgcgcacgacagccgauacaaguucagagggcuaggcauucaaagccuggacguacucgaaaagugccaaaucgacguacuagggcacgucucuguaguacgaagugagaaaagaaugggauucaguuga

SEQ ID NO: 7485 - RNA, 3423 nt, Artificial Sequence
  Cas9 variant
augaacggccuggugcucgggcuggacaucggcaucgccagcgucggggugggcauccuggagaagaacuccgggaagaucgugcacgccagcucccgcaucuuucccgcggcgaccgccgacaacaacgucgagcggcgcaagaaccggcaggcccgccggcucaaccgccggaaaaagcaccgcggcgugcgguuccaggaccuguucgaggacuacggccugcucaccgacuucagcaagguguccaucaaccugaacccguaccgccugagagucgacgggcucaaccagcagcugacgaacgaggagcuguucaucgcccucaagaacaucgugaagcgccggggcaucagcuaucuggacgacgcguccgaggacgggggcaccgugagcuccgacuacgggaaggccguggaggaaaaccgcaagcugcucgccgagaagacccccggccagauccagcuggagcgguucgagaaguacggccagcugcgcggagacuucaccgugguggagaacggcgagaagugccggcucaucaacgucuucagcacguccgccuacaagaaggaggcggagcgcauccugcggaagcagcaggacuucaacaaccaaaucaccgacgaguucaucgaggacuaccugaagauccucaccgggaagcgcaaguacuaccacggccccggcaacgagaagucccggaccgacuacgggcgcuacacgacccacaaggacaguaagggcgaguacgugacacuggacaacaucuucggggugcugaucggcaagugcaccuucuaccccaacgaguaccgcgccagcaaggccuccuacacggcacaggaguucaaccuccugaacgaccugaacaaccucaccgucccgaccgagaccaagaagcugagcgaggagcagaagaagacgaucaucgaguacgcaaaguccgcgaagacccugggggccagcacccuccugaaguacaucgccaagaugaucgacaccuccguggaccagauccggggcuaccgcguggacgucaauaauaagcccgagauccacacguucgagguguaccggaagaugcaaagccuggagaccaucagcgugggcgagcucucccgcaacguccuggacgagcuggcccacauccucacccugaacaccgagcgggaggggaucgaagaggccaucaacacgaagcugaaggacagcuucucccaggaccaggugcucgagcugguacaguuccgcaagaacaacagcucccuguucagcaagggcuggcauaacuuuucccucaaacuuaugauggagcugauccccgagcucuacgagaccagcgaggagcagaugaccauccugacccggcuggggaagcagaaguccaaggagacgagcaagcgaaccaaguacaucgacgagaaggagcucaccgaggagaucuacaaccccgucguggcgaaguccgucaggcaggccaucaagauuaucaacgaggcgaccaagaagcacggcaucuucgacaacaucgugauagagauggcccgcgagaacaacgaagaagacgccaagaaggacuacauaaagcggcagaaggcgaaccaggacgagaaguacgccgcgauggagaaggccgccuuccaguacaacggaaagaaggagcugccggauaacaucuuccacggccacaaggagcuggcaacgaagauucgccuguggcaccagcagggcgagaagugccucuacaccggcaagagcauccccaucuccgaccuuauccacaaccaguacaaguacgagaucgaccacauccugccccucagccuguccuucgacgacagccuguccaacaaggugcucguccuggccaccgcgaaccaggagaaggggcagcggacccccuuccaggcccuggacagcauggacgacgcgugguccuaccgcgaguucaagagcuacgugaaggagagcaagcuccuggggaacaagaagaaggaguaccugcucacugaggaggacaucuccaagaucgaggugaagcagaaguuuaucgagcgaaaccuggucgacacccgcuacagcucccguguggugcugaacgcccuccaggacuucuacaagaaccacaacuucgacaccaccaucagcgucgugcgcggccaguucaccucccagcugcggcguaagugggggcuggagaagucccgcgagacguaccaccaucacgccguggacgcccucaucaucgccgcuagcagccagcugcggcuguggaagaagcagaacaacccgcucaucgccuacaaggagggccaguucgucgacagccagaccggcgagaucaucagccugaccgacgacgaguacaaggagcugguguucaaggcccccuacgaccacuucguggacacacucuccagcaagacguucgaggacuccauccuguucagcuaccaggucgacuccaaguucaaccgcaagaucagcgacgccaccaucuacgccacccggaaggcgaagcuggacaaggagaagaaggaguauaccuacacgcucgggaagaucaaggacaucuacucccugggcaccaagacccccagcaagaccggguucuacaaguuccuggaccucuacaacaaggacaagagccaguuccugauguuccagaaggaccgcaagacgugggaugaggugaucgagaagaucauggagcaguaccggcccuucaaagaguacgacaaggccggcaagcugguggacuucaacccguucgagaaguaccgccaggagaacggccccauccggaaguacuccaagaaggggaacggccccgagaucaagagcuuaaaguacuacgauauccugcuggggaagcacaagaacaucacccccgagggcucccgcaacaccgucgccuuacugagccugaacccguggcggaccgacguguacuacaacauggagacgaagaaguacgaguuccucgggcugaaguacgccgaccugcccuucgaggagggcggcgccuacgggaucuccaccgagaccuacaacgagcuccgcgagaaggagggcaucgggaagaacagcgaguucaaguucacccuguacaagaacgaccugauacucaucaaggacacggaaaccaacugccagcaguucuuccgguucuggucccgcaccggcaaggacaaccccaagagcuuugagaaacacaagaucgaguuaaagcccuacgagaaggcgaaguucgagaagggggaggagcuggaggugcucggcaaggucccgcccuccuccaaccaguuccagaagaacaugcagaucgagaaccuguccaucuacaaggugaagaccgacgugcugggcaacaagcacuucaucaagaaggagggggacaagcccaagcucaaguucuga

SEQ ID NO: 7486 - RNA, 3423 nt, Artificial Sequence
  Cas9 variant
augaacggccuggugcucggacuggacaucggcaucgcuagcgucggggugggcauacugaagaaggacauuggggagaucauccacaccaacucccgccucuucucggccgcgacggccgacuccaacaucgagcgccgcggccaccggggcgggaaacgucugacccggcgaaagaagcaccggagcauccgccuccacgaucucuuugaggacuucggccugcugaccgacuuuagcaaggugagcaucaaccucaaccccuaccaacugcggguccaggggcuggacaaccagcucaccaacgaggagcuguucaucgcccugaagaacauugugaagcgccggggcaucuccuaccucgacgacgccagcgaggacgggggaaccgugagcucggacuacggcaaggccgucgaggaaaaucgcaagcugcuggcggagcaaacgccggggcaaauccagcucgaccgguucgagaaguacggccaagugcgcggggacuuuaacguggucgagaacggcgagaagcggcggcugaucaacguguucaccaccuccgccuacagcaaggaggcggagcggauccugcguaagcagcaggaguucaacaaaaagaucaccgacgaguucaucgaggacuaccucacgauccugaccgguaagcgcaaguacuaccacgggcccggcaacgagaagucccgcaccgacuacggccgguacaccacgaagaaggaccccgaggggaaguauaucacccuggauaacaucuucgggauccucaucggcaagugcaccuucuaccccgacgaguaccgcgccagcaaggcguccuacaccgcccaagaguucaaccugcugaacgaccucaacaaccugacggugccgaccgagaccaagaagcugagcgaggagcagaagaagaccaucaucaaguacgcaaagacggccaagacccucggcgccuccacucugcugaaguacauugcgaagcucaucggggccagcgucgaccagauccacggcuaccgcaucgaccccaacaagaagcccgagaugcacaccuucgagacguaccggaaaaugcagucccuggagacgaucagcguggaggagcugccucgcaagguccucgacgagcuggcccacauccugacccucaacaccgaacgggaggggaucgaggaggccaucaacgccacgcugaaggacaccuucagccaggaccaaguccuggagcucguccaguuucgcaagaacaacuccagccuguucuccaagggcuggcacagcuucuccuuaaagcuaaugauggagcugaucccggagcuguacgagaccagcgaggagcagaugaccauccucacaagacuggggaagcagaaguccaaggagaccagcaagcgcaccaaguacaucgacgagaaggagcugaccgaggagaucuacaaccccguggucgcgaaguccgugcggcaggccaucaagaucaucaacgaggcgacaaagaaguacggcaucuucgacaacaucgugaucgagauggcccgcgagaacaacgaggaggacgccaagaaggaguacaucaagcggcagaaggcgaaccuggacgagaagaacgcagccauggagaaggccgccuuccaguacaacgggaagaaagaacuacccgacaacgucuuccacgggcacaaagagcuggcgaccaagauccgccuuuggcaccagcagggcgagaagugccucuacacuggcaagaacauccccaucagcgaccugauccagaaccaguacaaguacgagauagaccacauccuaccguuaucccugaguuucgacgacucccugagcaacaaagugcucgugcuggcaaccgccaaccaggagaagggccagcggacccccuuccaggcccuggacuccauggacgacgcauggagcuaccgcgaguucaaguccuacgucaaggacagcaagcuccuggggaacaagaagaaggaguaucugcucacggaggaggacauauccaagaucgaaguuaagcagaaguucaucgagcgaaaccuggucgacacccgcuacagcagccggguggugcugaacgccuuacaggacuucuacaaggagcaccaguucgacaccaccauaucgguugugcgcggccaguucacgagccagcugcggcgcaaguggggccuugagaagucccgggagaccuaccaccaccacgccguggacgcccucaucaucgccgcgagcucccaacugcgcuuauggaagaagcagaacaacccccucaucagcuacacagaggggcaguucgucgaccaggugaccggcgagaucaucucccugagcgacgacgaguacaaggagcugguuuucaaggcccccuaugaccacuucgucgacacacucaaguccaagaaguucgaggacagcauccuguucuccuaccagguggacaguaaguacaaccgcaagaucuccgacgccacuaucuacgccacccggaaggccaagcuggacaaggagaacaaggaauacaccuacacgcucgggaagaucaaggacaucuacgcucugggcaccaaaagcccguccaagaccggcuucuacaaguuucuggaccucuauaacaaggacaagagccaauuccugauguuccagaaggaccgcaagaccugggacgaggugaucgagaagaucauugagcaauaccggcccuucaaggaguacgacgagaacgggaaggaggucgacuucaaccccuucgagaaguaucgcaucgaaaacggcccaauccggaaguacuccaagaaggggaacggcccggagauuaagagcuugaaguacuacgacaaccuccuagggaaguucgucgacaucacgcccagcgaguccaagaaccccguggcccugcucucucucaaccccuggcgcaccgacgucuacuacaacaccgagacauccaaguacgaguuucugggccucaaguacgccgaccuuugcuucgagaagggcggugccuacggcaucagcgagguuaaguacaacaagauucgggaaaaggaggggaucggcaaggaauccgaguucaaguuuacgcuguacaagaacgacuugauccugaucaaggacaccgagaccaacugccagcagaucuuccgcuucuggagccggaccgggaaggacaacccgaaguccuucgagaagcacaagauagagcugaagcccuacgagaaggcccgcuucgagaagggcgaggagcucgaggugcugggcaaggucccgcccagcuccaaucagcugcagaagaacaugcagaucgagaaccucagcaucuacaaggugaagacugacgugcuggggaacaagcacuucaucaagaaggagggagaggagcccaagcugaaguucuga

SEQ ID NO: 7487 - RNA, 3423 nt, Artificial Sequence
  Cas9 variant
auggaggaaaacuuccaguacagaaucgggcucgacaucgguauaaccucaguaggaugggcagugcuacaaaacaacagucaagaugagccugugcguauaaccgaccucggcguacgcauauucgacgucgcagaaaauccgaaaaacggggacgcccuagccgcuccacgaagggacgcacguaccacaagaagacgccuuagacgccgccggcaccgacuagaacgcauuaaauuccuccuccaagagaacgggcucauagaaauggacuccuucauggaacgauacuacaaaggaaaccuacccgacgucuaccaacuacgcuacgagggacucgauagaaaacugaaggacgaggaacuagcccaagugcucauacacauagcgaaacaccggggauuccguucgacgcgaaaagcagaaacuaaaggaaaggaaggaggggccgugcugaaagcaaccaccgaaaaccagaagaucaugcaagaaaaaggauaccgaacggucggagaaaugcuguaccuagacgaggcauuccacaccgaaugccucuggaacgaaaaaggauacguacucaccccaagaaaccgaccggacgacuacaaacacacaauacucaggucgaugcucgucgaagaaguucacgcaaucuucgcagcccagcgagcacuaggaaacgaaaaagcgaccgaagaauuagaaaacgccuauguagaaauaaugaccagccaacgguccuucgacauggggccaggccuacagcccgacggcaaacccagucccuacgcgauggaaggcuucggagacagggucggcaaaugcacauuugagaaagacgaauacagagccccgaaggcaaccuacacggcagaauuguucgucgcacuacagaaaaucaaccacacaaagcugauagacgaguucggcaccggacgauuuuucacagaagaagaacgcaagacgauaauagaccuucuccuaagcggaaaagaacucaaauacgggacaauacgaaagaaacugaacaucgacccgagccuaaaauucaacucccuuaacuacagcgccaaaaaggaaggagaaaccgaagaagaacgaguacgcgauaccgaaaaggcgaaauucgccagcauguucuggaccuacgaguacucaaaaugccuaaaagacaggaacgaagaaaugaccgucgggcaaaaagcggaccugcucgacagaaucggcgaaauccugacagcauauaaaaacgacgauucgagaucaagccgacuagaggaccugggauugagccgcgaggaaaucgauggacuacucgaguugagcccagcaaaauaccaacgagucucacugaaagcaaugcgaaaaaugcaacccuaucuggaagacggccucauauaugauaaggcaugcgaggccgccggauacgacuucagagcgcugaacgacggaaacaagaaacaccuccuaaaaggggaagagaucaacgcaaucgucaacgacauaaccaacccgguaguaaagagaagcgugagccaaaccauaaaggugauaaacgcaauaauccaaaaguacgggagcccacaagcagucaacaucgaacuagccagagaaaugagcaaaaacuuccaggaccgaaccaaccuggagaaggaaaugaagaaaagacaacaagaaaacgagcgcgccaaacagcaaauaauagaacuaggaaagcaaaacccaacgggacaagacauccucaaguaccggcucuggaaugaccaaggaggcuacugucuauacucagggaaaaagaucccgcuagaggagcuauuuggcggaggcuacgauauagaccacauauuacccuacaguaucacguucgacgacagcuaccgaaacaaagugcuagugaccgcccaggaaaacagacaaaagggcaaccgcacccccuacgaauacuucggugcggacgaaaaacacugggaggauuacgaggcaaggguacggcuauuaguucgggacuacaagaaacaacagaaacuacugaaaaagaacuucaccgaagaagagagaaaagaguucaaggaacgcaaccuaaacgacacaaaguauaucaccaggguaguauacaacaugauacggcaaaaccuagaacuggaaccauucaaccacccagagaaaaagaaacaggucugggcagucaauggcgcagucacgagcuaccugcggaagcgauggggccucaugcaaaaggaccgaagcacagaccgacaccaugccauggacgcaguaguaaucgcgugcugcacagacggaaugauacacaaaauaagccgcuacaugcaaggacgcgaacuagcauacucuaggaacuucaaauuucccgacgaagaaaccggagaaauccugaaccgcgacaacuucacaagagagcagugggacgaaaaauucggagucaaaguaccacuccccuggaacuccuuccgggacgagcuggauauccgacuccuaaacgaagaccccaaaaauuuccugcuaacgcacgcggacguccagagagagcuagacuacccaggauggauguacggagaggaagagucgcccaucgaagaagggcgcuauaucaacuauauccgcccacucuucgugagccgcaugccuaaccacaaaguuacgggauccgcacacgacgcgaccauccgcuccgcgcgcgacuacgagacaaggggaguaguaaucacaaaagucccucucacggaccugaaacugaacaaagacaacgaaauagaaggcuacuacgacaaagacagcgaccgccugcuguaccaagcacugguacggcagcuacuucuacacggcaacgacgggaaaaaggcguucgccgaagacuuccacaaaccaaaagcagacggaacagagggcccuguaguaaggaaggucaagauagagaaaaagcaaaccagcggcguaaugguccgcggagggaccggaaucgcagcgaacggagaaauggugcgcaucgacguguuccgcgaaaacggcaaguauuacuucguacccguauacaccgcagacguagucaggaaagugcuacccaaccgcgcagcaaugaacggaaagauagccucagauuggaaaacgauggaagacaauaacuucguguucucacuguacagcagggaccuaauacaugugaaaaggaagaaagcaauacccacgauacuaagcagcggcgcgacauuugaacaagaggaguucuaugccuacuucaccggcgccgacaucuccacaguuagcauagcgggaaucagcaaugacaacucuuucaaguuccguggccucggcauucaaggacuagaaauauucgaaaaaugccaagucgacauauuagggaacauaucaguagucaggcacgagaacaggcaaggguuccauuga

SEQ ID NO: 7488 - RNA, 3426 nt, Artificial Sequence; identical to SEQ ID NO: 1688
  Cas9 variant

SEQ ID NO: 7489 - RNA, 3429 nt, Artificial Sequence; identical to SEQ ID NO: 1689
  Cas9 variant

SEQ ID NO: 7490 - RNA, 3435 nt, Artificial Sequence
  Cas9 variant
augacaagcaagcaagaaaaacacggagcgcuuaccuucgggcuggauaucgggaucgcauccguuggaugggccguacucggcgaaucuagaaucguggaccucggagucaggugcuucgacaaagccgaaaccgcgaaggaaggagaaagccucaacuuaacaagaagaauggcaagacuccucagacgaagacuacgccggcgcgccuggcgccugacgaagcuagcacggcuacuaaaacgagaggggcuuaucgcagaugcgaaccucuucaagcauaagaucgagaaaaauacuccaguacccaaaucaucauggcaacucagggucgauggacucgacagacaauuaaacgcagaagaaugggcccgcgugaucuaccaccugugcaagcaccgcggcuuccacuggaucucacgagcagaagaaaaagccgcagaaggcgacagcaaaggcgaaggaggaaaaguaaagcaaggacuggccggcaccaaaaagcuaaugcaagaaaagucauaccgcaccgcagcagagaugguccuugccgaguuccccgacgcccaacggaacaaacaaggggacuacuccaaagcacuaaguagaauacugcucggcgacgaacucaaagcacuauucgaacaccagcggaagcuggguaaccccguagcuaccgaaaaacuagaagccgccauucucggaaacggagacaaaaagugcgggcuauucugggcacaaaaccccgcccuggccggcaacaaacuccucgaaaugcucgggcgcugcacguucgagaaaaccggcggcgaugacgggaaaggagaauaccgcgcaccaaaagccucauuuagcgcagaaaggcacguauggcugacacaccucaacaaccuaagaaucgugguagacggcaccacacguccccugaacgaagcagaacgacgcgucgcacucccgaugccauaccaacaagcaggcgaucuaagcuacaaacaacuagguggagcuuuaaucaaggaaggauuccuucaaaaagacggcuucaaguuugcaggacuccccuacccaaccaaacaagccagcgaggaaaaagcaaaggacccggaaacaucaguguuaugcaaacuaccggccuggcacacccuccggaaaacccuagagaaacacggccuagaaucugaauggcaaaaacuauccaccgaugcccuugacggaaaaccacaacuacuagacaacaucgcaugggugcucagcguguauaaagaugacgacgaaguaaaaaccgagcucggaaaauuaaaccuaccaaacacagagaaaaugauugaugcccuccuagacauacgguucgauaaauucuccaaccuaagccucaaagcccucagcaagaucguacccuucauggaacaaggccaacgcuacgacgaagcggucgcaaacauaccagaauacgggcaccacagucagcuccacaaaguaggcgcaggcgaacacaaauaccuucccccuuucuacaaggaacgagacaagacggguaggaugguauucaacgacgacauggacauaccccgcaaccccguggugcuccgcgcacucaaccaagcgcgaaaaguaguaaaugcgcuaaucaaagaguacggaagcccacacgaaguacacauagaaauggcccgagaccuaucgcgaccacuagacgagcguagagacauagaaaaacuccaaaaagaguucggagaacggaauaagaaagacaaagaacuuuucgcgcaggacuucaacaucguaggaacggucaaaggcaaacaauuugaaaaguaccagcuauacagagagcaacagggcaaaugcaucuaucccagcauggacgaaaagcaagguauaugcugcuacagccugaagccguuggaccuccaucguguacuauacgaggaaggcuacgcagaaauagaccacgcccuccccuacagccggucauucgacgauagcaaaaacaaccgaguccuaguccuggccaaagaaaacagggacaaagggaacagaaccccguuugaauaccuaggggacaaagacaauagcgaaccguggagacaauucgucgcauucgucgagggcaacaaggcuuaccgacuagcgaaaaggagcagacuccugcgcaaagacuuuggagacaaagaagcaaaagaguuccgagaaaggaaccuaaacgacacacgcuacaucugcaaauucuucaaaaacuauguagaacaauaucugcaacuacacgaagacagcgaggccaaacgaugcguaguccucuccgggcagaugacgagcuuccucagagcccgauggggacuggucaaaguccgaggcgacuccgaccgacaccacgcccucgaugcugccguaguagcagccugcagccacggcauggugaaaagacuaagcgacuacagccgccgaaaagaacuagagcaaguaagagagggguuuguagacguggacacaggggaaaucgugaacccagcgauguuccaacaagugcaggaacauuuccccaaccccuggccccacuuucgcgacgaagucaaacugagacucagcauugacgauccgacccugcuccgaucagagauggaaaaauucggcaccuacacaccagaaagccuagaagcauuacgaccucuauuuguaagccgagccccucaacgaaggaacucuggagccgcccacaaggacacaauauacgcgcaacccaaaaggcuagucgcacaaggcggagucacccaaaagguggcgcucucaagccucacccucaaggaccuagacaaauugaucgacccccaccgaaacgaaagacucuacgcggcaaucagagcccgucucgagcaacacggaggaaagggagacaaagcauuccccgcuucaaaccccuuacgaaaaccggacuccgaaggcaacccaaccggcccaauaguccgaggagucacgauggucaucgacaaacucagcggcaucccaauccgaggcggaauagcgaaaaacgacuccaugguaagaguagacguauucacgaaggcgaacaaauuccaccuaguacccguauacgugcaccacagcgugcuagggcuuccaaaccaagcaaucgucgggggaaaagaagaaagcgaauggacccaaauagacgacucauucgacuggcauuucagcaucuauccgaacgacuugauacgcgucacacugaaacaagagggucgguucggauacuacgccgguugugaccgaagcacagcagccauacaccuaugggcccacgauagaaaccaacaaguaggaaaggacggacuaaucagguccauaggagucaaaaccgcucucaguauagaaaaauucaacguggacguacucgggaaccgcuaccccgccccacccgaaaagcgccgagaccuugcguga

SEQ ID NO: 7491 - RNA, 3435 nt, Artificial Sequence
  Cas9 variant
augacgagcaaacaagagaaccucggggcgcucaccuucggacuggacauugggaucgccagcgucgggugggcgguacucggcgaaaaccgaaucauugaccucgggguucgauguuucgacaaagccgaaaccgcgaaagagggggaaagccucaacuuaacaagacgaauggcucgacuucucagacgccggcuaagacgucgugccuggcggcuaacgaaguuggcaagacuauuaaagcgcgaaggauugaucgcugacgcaaaccucuucaagcacaagaucgagaagaacacaccagugccaaaaucaucguggcaacucagagucgacggccuggaccggcaacuaaacgccgaagaaugggcacgcgugaucuaucaccugugcaaacaccgaggguuccacuggauaucccgagccgaagagaaggcagcagaaggagacagcaaaggcgaagggggaaaggucaagcaaggauuagccgggacgaagaaacucaugcaagaaaaauccuaucgcaccgcggcugaaauggucuuagcggaguucccagaugcccaaagaaacaagcaaggagacuauucaaaagcauuauccaggauccucuuaggagacgaacuaaaagcacuauuugaacaccagcgcaaacugggcaacccaguugccaccgaaaagcucgaagccgcaauacuagguaacggggacaagaaaugcggccucuucugggcgcaaaaccccgcgcucgcaggaaauaaacuacuugaaaugcuaggcagaugcaccuucgagaaaacaggaggcgacgacggaaaaggcgaauaucgagcaccgaaagccagcuucagcgcagagcggcacguauggcuaacucaucuaaacaaccucagaaucgucguagacggcacaaccaggccucuaaacgaggcugagcgaagaguagcucucccaaugccauaccagcaggccggagaccucucguauaagcaacugggcggcgcacuaaucaaggaaggguuccuccagaaagacggauuuaaguucgccggccuaccauaucccacaaaacaggcuucggaagaaaaagcgaaagacccagaaaccucaguacuuugcaaacuacccgccuggcacacacuacgaaagaccuuggagaaacacggccuggaauccgaauggcaaaaacuuucgacagaugcacuagacggaaaaccccaacuccucgacaacauagccuggguacuaagcguauauaaggacgacgacgaaguaaaaacagaacugggcaaacucaaccuacccaacaccgagaaaaugaucgacgcauuauuagacauccgauucgacaaguuuagcaacuuaagccucaaagcgcuguccaaaauaguacccuucauggaacaagggcaaagguaugaugaagcugucgcgaauauaccggaauauggacaccacagccaacugcacaaaguaggcgcaggcgaacacaaauaccuaccgcccuucuacaaagaacgcgacaaaacaggccgaaugguauucaacgaugacauggacauuccgcgaaacccagucguccugcgcgcgcucaaccaagcacgcaaggucgucaacgcacuaaucaaagaauacggcucaccacacgaaguccacauagagauggcgcgagaccuuucccgcccccuagacgaaagacgcgacaucgaaaaacuccagaaggaguucggagaacgaaacaagaaagacaaagaacuauucgcacaggacuucaacauaguagggaccgucaaaggaaaacaauucgaaaaauaucaacucuacagagaacagcaagguaaaugcauauacccauccauggacgagaaacagggcauaugcuguuacagccugaaaccgcuagaucugcacaggguacuauacgaagagggguacgcagaaauagaccacgcccugcccuacucucgcagcuucgacgacagcaagaacaaccgcguacucgugcucgcgaaagagaaccgagacaaaggcaaccgcacaccauucgaauaccucggcgacaaagacaacuccgaaccguggcgacaauucguagccuucguugaaggcaacaaagccuaccgucuagcaaaacgcagcagacuccuacgcaaagacuucggggacaaagaagccaaagaguuccgugaaagaaaccucaacgacacccgauacauaugcaaauucuucaagaacuacgucgaacaguaccuacaacuacaugaagacagcgaggccaaacgaugcgucguccucucgggccaaaugacaaguuuccuaagagcccgauggggacucguaaagguaagaggcgacuccgacagacaccacgcccuugaugcagcagucguugcugccugcagccauggaauggugaagcgauuauccgacuacucccgccgcaaagagcucgaacaggucagagaagguuucguggacguagacacuggagagauaguaaaccccgccauguuccaacaaguccaagaacacuucccaaacccauggccgcacuuccgagacgaggucaaacuccggcucaguaucgacgaccccacacuccuccgcucagaaauggagaaauucgguacauacacaccagaaagccuagaagcccuacgcccgcuguucguaucacgggccccacagcgacgcaacagcggagccgcucacaaagauacaauauacgcacaaccaaaaagacucguagcccaaggaggagugacacaaaagguugcacuaucgucacugacguugaaggaccuagacaagcucauagacccccauagaaacgaacgccuauacgcagcaauaagagcacgucucgagcaacauggcggaaaaggagacaaagccuucccagcgucaaacccgcuacgcaaaccggacagcgagggaaaccccacaggcccgauaguacgagguguaacgauggucaucgacaagcuaagcggaauaccaauccgcggcggaauagcgaaaaacgacuccauggugcguguggaugucuucaccaaagccaacaaauuccaccuagucccaguauacgugcaccacagcgugcucggacuaccgaaccaagcaauuguagguggcaaagaagaaucagaauggacacaaauagacgacagcuucgacuggcacuucagcaucuaucccaacgaccucauccgaguaacacugaagcaagagggcagauucgguuacuacgccggaugcgacagaucuaccgccgcaauccaucugugggcgcacgaucgaaaccaacaggucggcaaagauggacuaaucagaucgauaggggucaaaaccgcacugucaauagaaaaauucaacguagacguccucgggaaccgguauccagcaccaccggagaaacgaagagaccucgcauga

SEQ ID NO: 7492 - RNA, 3438 nt, Artificial Sequence
  Cas9 variant
augaagaccauccuggggcucgaccuggggaccaacagcaucggcugggcccuggugaaggagacggagaacuccaacgagaaguccgagauuaucaagcucgggguaagagucaacccccugaccguggacgagaagaccaacuucgaggccggccggccgcugagcaccaacgcggaccgcacggccaagcggagcgcccgccggaaccuccagcguuacaagcugcggcgcaagaaccugaucgaccuccugaucaagcaccggcugaucgacaaggacacgccccucaccgaaaucgggaagaacaccacccaccagacccuggagcugcgcgcgaaggccgcgcgggagcguaucgagcucgaggaccuggcgcgggucuuucuggccaucaauaagaagcgcgguuaccgguccagccgcaagguuaacaacgaggaggagggccaggugguagacgggauggccguggcgaagaagcucuacgacgagaaccugacgcccggccaguacgccuacgagcugcucuccaaggggaagaaguacgugccugacuucuacagaagugaccugcaggcggaguucgacuccaucugggaguaccagaagcaguucuacgccgauauccucgacgacgaacucuacaacgcccugaagggccaggggcagcagaacagccgaaagcgguuccuggcgaucaagggugucuacaccgccgagaacaagggaaagcgcgacgaggugaagcuccagcacuacaaguggcgguccgaggccaucacgcagaagcugagcaucgaggagguggccuacguucugguggagaucaacaacgaccucaacaagagcaguggguaccugggcgccaucuccgaccgcagcaaggagcuguacuucaacaaggagaccgugggggagaacuuauggaagcagauccagaagaacccgcacacuucccugaagaaccaggucuucuaccgccaggacuaccuggacgaguucgaacagaucugggaaacccaggcgcaguuccacccccagcucacgcuggcccugaaggagcagauccgggacguagugauauucuaccagcgcaagcucaagagccagaagggccugcuguccuucugccaguucgagagcugggagaucgagaggaaggacgagaacggcaacgucauacucaacaagaccacccagcugccaaagcgccaaaccguagggcggcgcguggcccccaaaagcuccccgcuguuucaggaguucaagaucuggcagaacaucaacaaccucgagaucgccaagaucucggacgguaacuccaagaacaagaaggagacugaagcccuaagcgacgacgaacggaaacuucuguuugaagaacugaaccugcgcgggaaccugucccaaaaggagguccuccagauccugggccugaaggacaaggaguacaagacgaacuuccccgaggggcucgagggcaaccggaccaacgccgcccuguucaacaucuaccagcagaucgccgagaacgagggcuacggggacuggaccaagaaauccgcccaggagaucaaggaggaacugaaggccguguucccccagaucggcauccaggcggacauccucgacuucaacgccgagcuggacgggaaggaguucgagaaccaggcgagcuaucagcuguggcaccuccuguacuccgccgaggaggacgacaagauuaacgaggaggaccagaucaucuacggcaacuccgcggugagccugaagaaaaagcucugcgagaaguucggauucacgccagaguacgccaaguggauagccaacgucucccugcaggacgacuacggcaaccugagcaccaaggccaugcgcaagaucaucccguaccuuaucgacggcaacgacuacuccgaggccugcgcgcuggccggguacaaccacagcaacucccucaccaaggaggagaacgacaaucgggagcgccucaacaagcuggagcugcuccccaagaacagccugcggaaccccguggucgagaagauccuuaaccagauggugaacguggucaaccaggugaucgagaccuacggcaagcccgacgagguucgcaucgagcucgcccgggagcugaagaaguccgccgaggagcgcgccgagaugacgaaggggaucaaugaggcgacccggcgcaacgaggacauaaagaagcugaucaccaagaacuucggcaucccgaaccccaccaagaacgacgucgugcgguaccggcucugggaggaacuagcgccccuagccuacaaggacguguucacggggcgucagaucaagaaggaggaccucuucagcuccaagaucgacaucgagcacaucauacccaaggcccugcuguucgacgacucuuucagcaacaaaacccucgccuuccgggagacgaaccugaagaaggccgaucgcaccgccuauggauucaucgagucggauuacaacgccacgcuggacgacuacauccaacgggucgagacccucuacaacaacgccaagggcaccauuagcaaggggaagcgcaacaagcugcugauggcgcagaagaaccuuccggacggcuucaucgagcgggaucugcgcaacucccaguacaucgccaagaaggccaagagcaugaucgagaagguguucaacgacgugaacgucaccagcgggagcaucaccgacaggcugcgcgaggacugggaccucaucaacgugaugaaggagcugaacuuccccaaguacaaggcucugggccucacugagaucgaggagcgguacgauaucgggcaggagaagaccaagaagguggaggucaucaccgacuggaccaagcgcaacgaccaccggcaccacgccauggacgcgcugacgguggccuucaccaccaagucccacguccaguaccugaacaaccucaacaccauccacagccugaagggggacgaggucgaccuggagcucuccaagcuguacggacugaagaacacgaucaccgagguggugaacaagaagcgcaaguucaucccgcccaugcccaacuuccgggaggaggccaagaagcacauugagaccauccucgucagcauaaagaacaagaacaagguguacaccaagaacaucaacaagacgaagaaggaguccggguaccacaccaaggagcagcugacgccccgcggccagcugcacaaagagaccguguauggcaagagcaaacggcccaugaacaaacccaccaagaucaacaagaacuucucccuagagcaagcccagcugaucaucaacguccaggagaaggagcuggugcuccgccaccuggcucaguucgacaauaacccggcgguugcuuucgacaccaagacacugaagaagugccacuaccucaagauggucaaccuguga

SEQ ID NO: 7493 - RNA, 3441 nt, Artificial Sequence
  Cas9 variant
augagcggcaacacucacggaccccuuacauucggcuucgacauaggaaucgccagcgucggcuggugcguacucggcgaaaaccgcauaguaaaucuaggaguccggugcuucgacaaggcagaaaccgccaaagaaggcgaaagccucaaccuagcacgaagaacggccaggcucaugaggagaaggcucagaagacgagccuggagacuaaccaaacuggcaaggcuacugaagcgagaaggacucaucgcagaagcaucacguauucacauccccagcccagugagcccuuggagacucaggguagagggcaucgacaggagacucacggacgacgagugggccagggugaucuaccaucuaugcaaacauagaggauuccacuggauaagccgggcggaggaacgcaaagcggaaagugacgccaaagagggcggccgagucaagaaagggcuaucggacacccagcggcgaaugacggaaaaaggauacagaagcgcugcagaaaugguacucgcggaguuccccgacgcccagcggaacaaacaaggcgacuacgggaaagcauuaucgcgcauacuacucagcgacgaacuagcauuauuauuccguagacaaagagaacugggcaaucccaacgcgggaaaugaacuagaagccacgauacuggguaacgguaaccgcaaauccggccucuucugggaacaaaaacccccacuugcaggcgccgaccuccucaaaaugcuaggcagaugcacguucgagaaaaacgaauauagagccccaaaagccucauucaccgcagaaagacacgucuggcucaccagacucaacaaccuacgugucguagucgacggcacaacccgcagccuagaugacgccgaacacagacugguuuuaccccucccguacaaacaagccggagacuucacauacaagcaacuaagaacagcccucacaaaagcaggacuccugcccgaaggauucaaauucgcaggucuaagcuauccgacaggccgacagcuagacgacccaaaagccaaggaccccgaaagcgaaaaauuagucagacuccccgcauggcaagaacucagaaaaacacuaaaagacaagaaccuagagacugagugggaaggaauggcaggagccgccaccggcggaaaccccgaacugcucgacgaaauagcgagaguccucuccguuuuuaaggacggagaugagguaacagcagaacucuggaaacuaccccuaccaggaggcaaagcaaugaucgacgcccucucagaaauuuccuucgacaaauuccacgcacuaucacugaaggcacuacggaaaaucguaccccacauggaaucaggccucagauacgacgaagcgugugcggucgccggcuaucaucacucucagcuccaugcagcgggugcaggcgagcacaaauuccucccacccuucuacagcagacgcgacaaggacggcagaauggucuucaacgaggaacuagaugucccaaggaaccccgucgugcucagggcacucaaccaagcccgaaagguacucaaugcacucguacggacauacggaagcccgacagcgguccacaucgaaauggcacgcgaccuaucccguccacuagacgaaagaaacaaagugaaaaaggcacaagacgaauaucgcgagcgaaacgaaaaagacaaagcagccuucgcagcagaguacggcaucgcgccaaaaagcagagaguucgaaaaauuccagcuuuaucgcgaacagcaaggaaagugcgccuacucgcuaaagucccuagaucugcaccgcguacuacacgauaucggauacgcagaaguggaccaugcccuaccauacagccgaagcuacgacgauagcaagaacaacaaaguacucgcccuaacagaagaaaaccguaacaaaggcaaccggacagccuacgaguaucugacuucauuccccgguggcgaaaacggagaaagauggcggaacuucagcguagccguugaaaccaacaaagcauaccgacucgcgaaacgaacacgacuccuccgaaaagacuucuccggacgcgccgcggaagaguuccgagaacggaaccucaacgacacucgauacauaugccgauuuuucaaaaacaccguagagagauuccucaaacuagacgcaaaaguaggcgccggcgacaccgccgagauaagcgcgaaaagaugcgugguacuuucaggacaaacgaccgcauuucuacgcgcuagauggggacuccugaagguccgagggaacagcgaccgccaucacgcgcucgacgccgcagucguggccgccugcucccacgguauggucaaacggcugggagacuauagccguacgaaagaauuagcgaagguccacgauggguucccggacccggagacgggagaaauaaucgaccccguaauguuccaacaacuccacgcucacuucccggacccguggccgcacuuccgagccgaacuugaggcucgccuuaacguggacgacacagccgauuuacgagcuagaauggaauuguucggcacauacgcaccugaagcgcucgaaacccugcggccgcuauucguaagccgcgccccacaaagaagaaacagcggcgcagcacacaaagacacaauauacgcacaacccgaaagacuaaaggaacaaggcggaguuacucaaaaaguccccuuaaccucccuaacccuaaaagaccuagacaaacuaauagacccccaccgcaacgaaaaacucuacgcggccauucgcgccagacuugaagcccacggaggcaaggccgacaaagcauuccccgccggaaacccccucagaaaacccgaccgagaaggaaaccccacgggcccagucguaagaacggucacaauggugauugacaaacucuccgggauccccguuagaggcggaauagccaagaacgacaccaugcuccgaguagacauauuccgccacaagaaagacgggaaauuccaccuagucccaguauauguauaccacgcaguagcgaaagaguucccgaaccgcgcaauaguccaggccaaagacgaagacgaauggacucuaauagacgauaaauucgacuuuugcuucagcgcacaucccaacgaccuacuaaaaauaacgcagaaaucgggggaaacaaucuucggauacuaccgagguugccacuccgguacggcggccaucaacauagcgcuacaugaccgauaugcauacgccgagaaaacaacaucacuagcguucucaaagaaaaaccccggcaaaccaauaccaaacgauaaacuaggacugauagaagggauagguguaaagauggccgccaauauggaaaaauuccacguagauacacuggggaacauauacccggccccacccgaacaacgacgcggccucgcuuga

SEQ ID NO: 7494 - RNA, 3441 nt, Artificial Sequence
  Cas9 variant
auggccuaccgccuaggacuggauauaggaauaacaagugucggcugggcgguggucgcgcuugaaaaggacgagagcggguuaaaacccgucagaauccaagaccuaggaguaagaauauucgacaaggcagaggacagcaaaacaggcgcgucccuggcgcucccucgacgagaggcaaggagugcacgcaggaggacaagacgacgacggcacagacucuggcgaguaaaaaggcugcuggaacaacacggaauacugagcauggaacaaauagaggcccucuacgcgcaacgcacaucgagccccgauguauaugcccucagggucgcaggccuggaccgaugccugauagcagaggagauagcgcgcguccucauacacaucgcacaccgaagaggguuccaaagcaacagaaaaagcgagaucaaagacagcgacgccggaaaacuacucaaagccguacaagagaacgagaacuuaaugcaaagcaagggauacagaacaguagcagaaaugcuagucagcgaagcaacaaagacagacgcagaaggaaagcuaguacacggcaagaaacacgguuacguguccaacgugagaaacaaggcaggcgaguaucggcacacugucagcagacaagcaaucgucgacgaggugagaaagauauucgcagcacaacgcgcacucggaaacgacgucaugucagaagaacuggaggacucuuacuuaaagauccuaugcucacaaagaaacuucgacgaugggccaggaggggauagcccauacgggcacggaagcguaucaccugauggggucaggcaaucaauauacgagcgaauggucgguucgugcacauucgaaacgggagaaaaacgagcaccgcgauccucauacucauucgaacgcuuccagcuacuaacaaaaguggucaaucuccgcauauaccgccagcaagaggacggaggacgauacccgugcgagcuuacacagacggagagagccaggguaauagacugcgcauacgagcaaaccaagaucacuuacggcaaacugcgcaaacuacuagacaugaaagauaccgaauccuucgccggccucacguacggacucaacaggucgagaaacaagacagaggauacaguauucgucgaaaugaaguucuaucacgaggucagaaaagcgcugcaacgagcgggggucuuuauacaggaucucagcauagagacauuagaccaaauaggauggauccuaucagucuggaaaucugacgacaacagacgaaagaagcuaagcacgcuaggccuauccgacaacguaauagaggaacugcucccacugaacggaagcaaauucggacaccucucgcucaaggccauacgaaagauccugccauuccuagaagacggcuauagcuaugacgucgccugcgagcuagcgggauaucaauuccaagggaagacagaauacguaaagcaacggcuacugcccccacucggggaaggagaaguaaccaacccagugguacgccgcgcgcugucacaagccauaaaagucgugaacgcagucauacgcaaacacggaagcccggaaucaauacacauugaguuggcgagagaacugagcaagaaccuagacgaaagacgcaaaaucgagaaggcgcagaaagagaaccaaaagaacaacgaacaaauaaaggacgagauaagggagauacuaggcagcgcgcacguaaccgggcgggacauuguaaaauacaaauuauucaagcagcaacaagaguucugcauguauagcggagaaaaacuugacgucacaaggcuguucgagccaggguacgcggagguagaucauaucauaccauacggaaucagcuucgaugacaguuacgacaacaaaguccucgugaaaacagagcagaaccgacaaaaaggcaaccggaccccucucgaauaccugcgcgacaaacccgagcaaaaagcaaaguuuauagcccugguagaaagcaucccacucagccagaaaaagaagaaccaccuacucauggacaaacgcgcaaucgaccuagagcaagagggcuuccgcgaacgaaaccuaagcgacacacgauauauaacccgcgcccuaaugaaccauauacaagccuggcuccuguucgacgaaacggccagcacccggagcaaaagagucgucugcguaaacggggcggugacugcuuacaugcgagcacgcuggggccuuaccaaagaccgcgacgccggagacaagcaccacgccgccgacgccguagucgucgcgugcauaggcgacuccuuaauacaaagagucacgaaauacgacaaauucaaacgaaacgcacuggcagaccggaaccgauacguccaacaagucagcaaaucagaaggcauaacccaauacguagacaaggagacgggcgaaguauucacaugggagaguuucgacgaacgaaaauuccugcccaacgagccacuagagccguggcccuuuuucagagacgagcugcuagcaagacuaagcgacgaccccagcaaaaacauaagggccauaggauuacugacauacucagagacggagcaaauagaucccaucuucguaagccgaaugccgacaagaaaagucacgggggcagcacacaaagagacgauucggagccccaggauagucaagguagacgacaacaaaggaacagagauacagguggucgugagcaaggucgcccucacagagcuaaaacucaccaaagauggagaaaucaaagacuacuucagaccagaagacgacccucgguuauacaacacgcuaagagaaagacucguccaauucggcggcgacgcaaaggccgcauucaaggagccaguauacaagauuagcaaggacggaucggugagaacccccguaaggaaagucaaaauccaagagaagcugacacugggagugccgguacacggaggucgagggauagccgaaaacggaggcaugguccggauagauguguuugccaagggcggaaaauacuacuuuguccccaucuacgucgcagacgugcucaagcgcgaauuaccgaaccggcucgcaacagcgcacaaacccuauagcgaauggaggguaguggaugacagcuaucaguucaaauucucccuauacccaaacgaugcuguaaugauaaagccgagcagagaaguagauauaacguauaaagaccggaaagaacccguaggcugccgaaucauguacuucguaagugcaaauauagcgagcgcaagcauaagccuacgaacgcacgacaacucgggugaauuggaaggacuagggauacaaggccucgaagucuucgaaaaauacguaguaggcccgcugggcgacacccaccccguauacaaagaaagacggaugccguucagaguagagcggaagaugaacuga

SEQ ID NO: 7495 - RNA, 3441 nt, Artificial Sequence
  Cas9 variant
auggcauacagacuuggacuggacaucggaauuacaagcguaggcugggcggucgucgcccuagaaaaggacgagagcggucucaagccgguacgaauacaggaccucggaguacggauauuugacaaagccgaggauagcaagacuggggcgucacuagcccugccgagaagagaagccaggucggccagaagacgcacgagaagacgaagacaccgacucuggcgaguaaaaaggcuccuugaacaacacggaauacuauccauggagcaaauagaggcgcuauacgcccaacgcaccagcuccccugacguguacgcacugcgggucgccggccucgacagaugcuuaaucgcagaggagauagcacgaguacugauacacauagcccacagaagaggauuccagucgaauaggaaaagcgaaaucaaggacagcgacgccggaaaacuacucaaagccgugcaggagaacgaaaacuuaaugcaaaguaaaggauacaggaccguagcggagaugcugguaagugaagccaccaaaacagacgcggaaggcaaacucguccacggaaagaaacacggcuacgucaguaacguuagaaacaaagcaggagaauaccgccacaccguaucgagacaggcgaucguggacgaaguccgcaagaucuucgccgcccagagagcacucggcaaugacguaaugagugaggaacucgaagacaguuaccuaaagauucuguguagccagcgaaacuucgacgauggaccaggaggagacucaccauacggccacggaucggugucaccagacgggguaaggcaaucaaucuaugaaagaaugguaggauccugcaccuuugagacgggcgaaaaacgugcaccaaggagcagcuauagcuucgagcgauuccaacugcuaaccaaagugguaaaucugcgcaucuauagacaacaggaagacgggggccgauauccaugcgaacucacccagaccgaacgagcccgcguaauagacugcgcauaugaacagaccaaaauuacauacggaaaauugcgcaaacuccuggacaugaaagacaccgaguccuucgcagggcuaacauacggccuaaaccgcucccggaacaaaaccgaagauacgguauucgucgaaaugaaguucuaccacgaaguaagaaaggcacuccagcgagccgggguauuuauacaagaccuaucaaucgagacacuugaucagaucggcuggauacucucaguauggaaaagcgacgacaaccgccgaaagaagcuaagcacacugggccucagcgacaacguaauagaggaacuacucccccucaacgggagcaaauucggacaucucucgcuaaaagcaauccgcaaaauccuaccguuccuagaggacggauacagcuacgauguagccugcgaacuggcgggcuaccaguuccagggaaaaacagaguacgucaagcaaagacuucuaccgccccucggagagggagaagucacaaaccccguagugcgccgcgcacucucacaagcgaucaaaguaguaaacgcagucauccgaaaacacggcagcccagaaucaauacauauugagcucgcacgagaacuuagcaagaaucuugacgaaagacgaaaaauagaaaaagcgcaaaaggagaaccaaaagaacaacgaacaaaucaaagacgagauaagggaaauucucgguucggcacacgugaccggaagagacaucgugaaauacaaacucuucaaacagcagcaagaguucugcauguacagcggugaaaaacuugacguaacacggcuauucgaaccaggguacgcggaagucgaccacaucauacccuacggcaucucguucgacgacagcuacgacaacaaaguccuaguaaaaacggaacaaaauagacagaaggggaaucgaacaccccuagaguaccuccgagacaaaccagaacagaaagcaaaauucauagcccucguagaaucaauaccacucucgcaaaagaagaaaaaccaccuccucauggacaagcgagccaucgaccucgaacaagaaggguucagagaacgcaaccugagcgacacacgcuacaucacacgagcgcugaugaaccacauucaagccuggcuacucuucgaugaaacagccuccacccggagcaagcgaguaguaugcguaaacggcgcgguaacagcauauaugagagcgcgcuggggcuugacgaaagaccgcaacgcaggggacaagcaccacgccgcugacgcaguagucguagccugcauaggggauucacucauacaacgggucaccaaauacgacaaauucaaacgcaacgcgcuagcagacaggaaccgcuacguccaacagguauccaaaagugaagguauuacacaguacguagacaaggaaaccggagaaguauucaccugggagagcuucgacgaaagaaaguuccugccuaacgaaccccuggaacccuggcccuucuucagggacgaacuccucgcgagacucucagacgacccaucaaagaacauccgggccauuggccugcucaccuauucagaaaccgagcaaaucgacccaauauucguaagucgaaugcccacgaggaaggugaccggggccgcccacaaagaaaccauccgaucacccaggaucgucaaaguagaugacaacaaagggaccgaaauccagguaguagucagcaaggucgcccuaacugagcugaaacucacaaaagacggcgaaaucaaagacuacuucagacccgaagacgacccacgccuguacaacacgcugagagaacggcuaguccaauucgggggagacgccaaggcagccuucaaagagcccguauacaaaauauccaaagacggcuccguccgaacgccaguacgaaaggucaaaauccaagaaaaacuaacacugggagucccugugcacggcgggcgagggauagccgaaaacggcggaaugguaagaaucgauguguucgcaaaggauggcaaauacuauuucguaccgauauacgucgcggacguacuaaaaagggaacucccgaacaggcucgcaacagcacacaagcccuacagcgaguggaggguaguagacgauagcuaccaauucaaguuuucccucuauccaaaugacgccguaaugaucaaaccaucuagagaaguggacauaacguacaaagaccgcaaagagcccguaggacuccggcuaauguacuucgccggggcggacauaucgggagcaacccucacccucagaacgcacgacaacucgggagagcuaaaaggccuaggcauccaaggacucgaagucuucgaaaaauauguagucggaccacugggcgacacccauccaguguacaaggaaaggagaaugccauucagaguagaacggaaaaugaacuga

SEQ ID NO: 7496 - RNA, 3447 nt, Artificial Sequence
  Cas9 variant
augaccaaacucaaccaaccuuacgggaucggccuggacauuggauccaauucgauaggcuucgcggucgucgacgcgaacucacauuuacucagacuaaaaggcgaaaccgcuaucggcgcuagacucuuucgagaaggccaaagcgcggcugaccgccgcggaucacgcaccacccgccgccgacugagccgaacccgcuggcgccuauccuuccuacgagacuucuucgcaccccauauaacuaaaauagacccugacuucuuccuccgucagaaauauagcgaaaucucccccaaagauaaggaccgcuucaaauacgaaaagcgguuauucaacgaccgcacagacgccgaguucuacgaagccuacccguccauguaccaccuacggcugagacuaaugaccgacgcaucccaggccgacccacgagagaucuuccuugcuauucaccacauccucaaaucccgcggacacuuccucaccccaggagcagccaaggacuucaauacagacaaagucgaccuagaagacauauuccccgcacucaccgaggcuuacgcccaagucuacccagaucuggaacuaacguucgaccuagcaaaagccgacgauuucaaggcaaaacuucucgacgaacaggcaaccccaucggacacgcaaaaagcccuaguaaaccucuugcuauccagcgacggcgaaaaagaaaucguuaaaaagcgcaagcagguacuaacagaauuugccaaggcaauuaccggcuuaaaaacaaaauucaaccucgcgcuaggcacugaagucgacgaagccgacgcgagcaauuggcaguucuccaugggacaacuagacgacaaauggagcaacaucgaaaccucaaugacagaccaaggcaccgaaaucuucgaacaaauccaggagcuguaccgugcccgccuacuuaacggcauaguccccgccggcaugagucuuucucaagccaaagucgcugacuacggacaacacaacgaagaucuggagcuauucaaaaccuaccuaaagaagcuaaacgaucacgaacuggcaaaaaccaucaggguuauauacgacagguacaucaacggagacgacgcaaaaccauuccugcgggaagauuucgucaaggcacuaacaaaagaagucacagcccauccaaaugaagucucggaacagcuccuaaaccgaaugggucaagcuaacuucaugcucaaacagcguaccaaggcaaacggcgccauccccguacaacuacagcaacgggagcuagaucagaucauagcaaaccaauccaaauacuacgacuggcuugcaaaaccaaaccccguagaaaaacaccgagccucgaaaccuuaccaacuugacgaacuccuaacuuucagaauaccauacuacgucggcccccucauuaccccaaaggaacaagcaaaaucaggcgagaacgucuucgccuggaugguccgcaaagaccccuccggcaauauaacgcccuacaacuuugaugagaagguagacagagaggcuuccgccaacgucuucauacagcggaugaagacaaccgauaccuaccuaauaggagaagacguccuucccaaacagucacuccucuaccaaaaauacgaaguacucaacgaacuaaacaacgucagagucaacaacgaggcacucggcacagaccaaaaacaacggcuuaucagagaaguauucgaaagacacuccucagucaccaucaaacagguggccgacaaccugguagcgcacggcgacuucgcacaacgaccagaaauccgcggacuagcugacgagaaacgcuuccuaaguucacuaucuaccuaccaccaacucaaggaaauacuacauggugccaucgacgacucuacaaagcuacacgacauagaaaauaucaucaccuggucuacaguguuugaggacgccgccauauucaaaaccaaacuggccgaaaucgacuggcuggacgccgcaaccauuaagaaacuaucaaacauacgcuaucgcgguuggggucaguucucucgcaaacuccuagacggccuuaaacucggcaauggacagacagucauccaggaacucaugcucagcaaccacaaccuuaugcagaucuugacagacgaaacucucaaaaccaccauggcggaacuaaaccaggacaagcucaaggccgacgacauugaagaugucaucaacgacgccuacaccucgcccagcaacaagaaagcacuucggcaaguacuccgggucgucgaagacauaaaacacgcggccaacggccaggacccgagcuggcuauacaucgagaccgcagacggccccggcacagccggcaaacgcacacaaagccgucagaaacaaauccaaacaguuuacgccaacgcagcacaagaacuaauugacagcgccguccgaggcgaacucgaagacaaaauugcggacaaggccuccuucacugaccggcucguccuguacuucaugcagggcggccgagauaucuacacaggcgccccgcugaacauagaccaacuuagccacuacgacauagaccacauccugccacaaaguuuaaucaaagacgacucacucgauaacagaguccuagugaaugcgacgaucaaccgggagaaaaacaacguauuuacauccacccucuucgcaagcaaaauggccgccaccuggcgcaaauggcaugaagcgggccucaucucaggccguaagcugcggaaccuaauguuaaggccugacgaaaucgacaaguucgcccacggcuucguugcccgccaacucgucgaaacacgccaaaucauaaaacuuacagaacagaucgccgccgcccaguacccgaacaccaagaucauagcgguaaaagccggccuaagccaccaacuccgagaagaacucgacuuccccaaaaauagagacgucaaccacuaccaccaugccuucgacgccuucuuagccgcgcgaaucggcacuuaccuccucaaacgauacgccaaacuagcccccuucuucacauacggggaguucgccaaagucgacgugaagaaauuucgcgaguucaacuucauaggggcccucaaacacgcaaagaaaaacauaguugccaaagacacuggggaaaucgucugggauaaagaaagagauauacaagaacucgaccgcaucuacaacuucaaacgcaugcuuauuacgcacgaaguguacuucgaaacggcugaccucuucaaacaaacuauauacgcggccaaagauucaaaagaacgcggcggauccaaacagcuaauaccaaagaaacgaggcuacccaacccaaguguacggaggcauccacgggaaaaucagacucaccuggcgcuggcuaaaacuccucagacggaagaagaugucuaucgaacucuccgaacuucaacugcuuaaguga

SEQ ID NO: 7497 - RNA, 3450 nt, Artificial Sequence; identical to SEQ ID NO: 1697
  Cas9 variant

SEQ ID NO: 7498 - RNA, 3459 nt, Artificial Sequence
  Cas9 variant
augaacgcagaacacggcaaagaaggccuccuaauaauggaagaaaacuuccaguaccggaucggacucgacaucgggaucacauccguaggaugggcaguucuacaaaacaacagccaagacgaaccaguacguaucacggaccucggaguaagaauauucgacgucgcagaaaaccccaaaaacggggacgcccuagccgcaccacgaagagacgcccggacaacgcggagacgccugagacgccgccgacacagacucgaacggauuaaauuccuccugcaggaaaacggauuaaucgagauggacagcuucauggaacgcuacuacaaaggaaaccuacccgauguauaccaacucagguacgaaggacuagacaggaaacucaaagacgaagaacuggcacagguccucauccacauagccaaacacagaggauuccgaagcacacgcaaagcggagacaaaagagaaagaaggaggagcgguccuaaaagcaacaacugaaaaccagaaaaucaugcaagaaaaaggguaccgaacagucggagagaugcuauaucucgaugaggcuuuccauacggagugccuguggaacgagaaaggauacguucuaacgccgcgcaaccggccggacgauuacaaacacaccauacuaaggaguaugcucguggaggaaguacacgccauauuugccgcucagcgggcccacggcaaccaaaaagccacggagggacuggaagaagcauacguagagauuaugaccucgcaacgauccuuugacaugggaccggggcugcagccagacggaaaaccaagcccauacgcaauggaaggcuucggagaccgagucggcaaaugcacguucgagaaggacgaauacagagcgcccaaggcaacauacacagcagagcuauucguagcacuccagaaaauaaaccauacaaagcugauagacgaguucggcacaggacgcuucuucuccgaagaggaacgaaaaaccauaauagggcugcuacucagcucgaaagaacuaaaguacggaaccauacgaaagaaacuuaacauagaucccagccugaaauucaacagccugaacuacagcgcaaagaaagaaggcgagacagaggaagagaggguccucgacacugagaaggcaaaauuugccucaauguucuggacauacgaauacagcaaaugccucaaagaccgcacagaggaaaugcccgugggagaaaaagccgaccuauucgaccggaucggagagauacuaaccgcauacaaaaacgacgauagcagauccagcagacucaaagaacugggccugagcggcgaagaaaucgacggccugcuugaccuauccccagcaaaauaccaaaggguaucgcucaaagcgaugcgcaagaugcaacccuaccucgaagacggccucaucuacgauaaagcgugcgaagccgccggcuacgacuuucgggcacucaaugacggaaauaagaagcaccuccuaaaaggagaagaaaucaacgcuauaguaaaugacauaacuaaccccguggucaaacgaucggucucccaaacaauaaaggucauaaacgcgauuauccaaaaguacggcaguccacaagcaguaaacaucgagcuggcacgggagauguccaagaauuuucaggacagaaccaaccucgaaaaagagaugaagaagcgucagcaggaaaacgaacgagcaaaacaacagauaaucgagcuaggaaagcaaaaucccaccgggcaagacauccucaaguaccggcucuggaacgaccagggcggcuauugccuguauuccggcaagaaaauaccccucgaagaacucuucgacggaggguaugacauugaucacauauuaccguacagcauaacguucgaugauagcuaccggaacaaagugcuagugaccgcacaagaaaacaggcaaaaaggcaacagaacgccauacgaauacuucggagccgacgagaaacggugggaggacuacgaggcaagcguccgacugcuaguacgagacuacaagaaacagcaaaaacuacucaagaaaaacuuuacagaagaagaacgcaaagaauuuaaagaaagaaaccuaaacgacacaaaauacaucacccgggucgucuacaacaugauccgucagaaccuagagcuugaaccguucaaccacccagagaagaagaaacaagugugggcgguaaacggagcggucaccuccuaucuacguaaacggugggggcuuaugcaaaaagaccggagcaccgacagacaccaugccauggacgcaguaguaauagccugcuguaccgacggcaugauccauaaaauaagcagauacaugcaagggcgggagcucgcuuauuccagaaacuucaaauuucccgacgaagagacgggcgagauacucaacagagacaacuucaccagagagcaaugggacgaaaaauucggagucaaaguaccgcuaccguggaacucauuccgagacgaacuagacauaagacuccucaaugaggaccccaaaaacuuccugcucacucacgccgacguacaacgcgagcucgacuacccaggguggauguauggggaagaagaauccccgauagaagagggcagguacauaaacuacauaaggccacucuucgucagccgaaugccaaaccacaaaguaacaggcagcgcacacgacgccaccauccgaucagcacgagacuacgagacacgcggcgucguaaucacaaaagucccucugaccgaucugaaacucaauaaagauaaugaaauagaaggcuacuaugacaaagacucagacaggcucuuauaccaggcuuugguacgucaacuccuccuacacggaaacgacggcaagaaggcguuugcggaagacuuccacaaacccaaagcggacggaaccgagggcccagucguacgaaagguuaagaucgaaaagaaacaaacaaguggagucauggugcgaggcggaaccggaauagcagcaaacggcgaaaugguaagaauagacgucuuccgcgaaaacgggaaauacuacuucgugcccguauacacugccgacguaguaagaaaagugcugcccaauagggcagcaacacacacaaaaccauauagcgaauggaggguaauggacgacgcaaacuucgucuucagccucuacucgcgagaucuaauccacgugaaaagcaagaaagacaucaaaaccaacuuagugaacgggggccuacuacuccagaaagagauauucgccuacuacacaggcgcagacauagcaacugccucuaucgccggauucgcaaacgauucgaacuucaaauucagggggcuagggauccaaagccuagaaauauuugaaaaaugccaaguagacauacucggcaacaucucggucgugagacacgaaaaccggcaagaguuccacuga

SEQ ID NO: 7499 - RNA, 3462 nt, Artificial Sequence
  Cas9 variant
augaaaaacauacucggccuagaccuaggccucucaucgaucggauggagcguaauuagagaaaacuccgaggagcaggagcuaguggccaugggcagcagagucguaagccuaacggcagcggaacucagcucauucacacagggaaacgggguguccaucaacagccaacgaacacagaaacgcacucagaggaagggauacgauagauaccaacuccggcgaacccuccuccgcaacaaacuugacacccuaggcaugcugccagacgacagccuuuccuaccugcccaaacuccaguuauggggccuacgagcaaaagccgugacucaacgcauagaacuaaacgaacuaggccgaguccuacuacaccucaaccaaaagcgcggcuacaaaucaauaaaaagcgacuucagcggagacaagaaaaucacagauuacguaaaaaccgugaagacccguuaugaugagcuaaaagaaaugcgacucaccaucggcgaacucuucuuccgccgacucacugagaacgccuucuuccgaugcaaagaacaaguauacccgcggcaagccuacguugaggaguuugacuguauaaugaacugccaaagaaaauuuuacccagacauccuaacagacgaaacgauccguugcauacgagaugaaaucauauacuaccaacgcccacucaaaucaugcaaguaccucgucucgcgaugcgaguucgaaaaacgcuucuaccuaaacgcagcuggcaagaaaaccgaggcgggacccaaagucucccccagaacuagcccccuguuccaaguaugccgccucugggaaucaauuaacaauauagucgucaaagaccgcagaaaugagauaguguucauuagcgccgaacaacgagccgcacucuucgauuuccucaacacucacgaaaagcucaaaggcagcgaccuacucaagcuacuaggauuaagcaaaacauacgguuaccgacuuggcgagcaauucaaaaccggcauucagggcaacaaaaccaggguagagaucgaacgagcauuaggaaacuacccggauaagaaacgccuauuacaauucaaccuucaggaagagucaucaaguauggugaacaccgagacaggugagauuauaccgaugaucucccucagcuucgaacaggagccccuguaccggcuauggcacguccucuacaguaucgacgaucgagaacagcuccagagcguacucagacaaaaauucgggauagacgacgaugaagugcucgaacgacucuccgcgaucgaccucguuaaagcgggauucggcaauaaaagcuccaaggcaauacgucggauccuacccuuucuccagcucgggaugaacuacgcagaagcaugcgaggccgcaggguacaaccacagcaacaacuacaccaaagccgaaaacgaagcacgugcgcuccuggaccgccuacccgcaauaaagaagaaugagcuccggcaaccugucgucgagaaaauccuaaaucaaaugguaaaugugguaaacgcgcucauggaaaaauacggacgcuucgacgaaauucgggucgagcucgcccgcgagcucaaacaauccaaagaagaaaggucaaacacuuacaaauccaucaacaaaaaccaaagagaaaacgagcaaaucgcaaaaagaauagucgaauacggcgucccuaccagaucccgaauccaaaaguacaagaugugggaggaaagcaaacacugcugcauuuacugcggccaacccgucgacgucggcgacuuccuccgcggcuucgacgucgaaguagagcauauaaucccaaaaagccuauacuucgacgacucauuugccaauaagguuugcuccugccguucgugcaacaaagagaaaaacaaccgcacagcauacgauuauaugaaaagcaaaggugaaaaagcccugagcgacuacguagaacgcgucaacacaauguacacgaacaaccaaaucagcaaaacgaaguggcagaaccugcucacgccggucgacaaaaucucaauagacuucauagacagacaacuaagagaaagucaguacaucgcccggaaagcaaaggaaauacuaaccuccaucugcuacaacguaacagccaccagcggcuccguaacaucguucuuacgacacgucuggggcugggauacuguccugcacgaucugaacuucgacagauacaagaaagucggccucaccgaagugauagaagugaaccaccgcggaagcgucauccgacgagagcaaaucaaagacuggagcaagcguuucgaccacaggcaucacgcaauugacgcacuuacaauagcgugcacgaaacaggcauauauacaacgacucaacaaccuccgagcggaagagggaccagacuucaacaagaugucccuagagagauacauacagagccaaccacacuucucggucgcccaaguucgagaagcgguggauagaauccucguuucauuccgagccggaaaaagagccgucacgcccgguaagcgauacauccgcaaaaaccgcaaaagaauauccguacaaagcgucuuaauccccagaggggccuuaagcgaagaauccgucuacggagucauccaugucugggaaaaggacgaacaaggucacguaauacaaaaacagcgcgcgguaaugaaauauccaaucaccuccauaaaccgagaaaugcuagacaaggaaaaagucgucgacaaacgcauccaccgcauacucagcggccgccuggcacaauacaacgacaacccaaaggaagcauucgcaaaacccguuuacauugacaaagaaugucgcauacccaucagaacagugcgcugcuucgcaaaaccagcaauaaauacguuggugccacuuaaaaaggaugacaaagggaacccggucgcuuggguaaaccccggaaacaaccaccacgucgcaaucuaccgugacgaagacggaaaauauaaagagcgcaccgucaccuucugggaggcaguagaccgcugccgcgucggcauuccugccauagucacacaacccgacaccauaugggacaacauccuacagcggaacgacauuagugagaacguccucgaaucccugcccgacgucaaauggcaauucgugcuaucccugcagcagaacgaaauguucauucuaggcaugaaugaagaagauuaccgcuacgccauggaccaacaggacuacgcacuacuaaacaaauaccucuacaggguccagaagcuauccaaauccgacuacuccuuccgcuaccauaccgagacaucgguagaagauaaguacgacggcaaacccaaccuaaaacuauccaugcagaugggaaagcugaaacgcgugucaaucaaaagccuucucggccuaaacccacacaaaguacacauaagcguucucggagagauaaaagaaaucuccuga

SEQ ID NO: 7500 - RNA, 3474 nt, Artificial Sequence
  Cas9 variant
augaacuacuacaauggcuucauaaucaccgaaaacgcaaugacgaguaaacaggaaaaacacggggcccugacauuugggcuagacauaggaauagcauccgucggcugggccguccucggcgaaagccgaauaguagaccucggcguccgaugcuucgacaaagcagagacagcaaaggagggagaaagccuaaaccucacacgucgaauggcccggcucuuacgccgaaggcuccggcgccgagcauggcgacugaccaagcuagcgagacuacuaaaaagggaaggacugaucgcagacgcaaaccuauucaagcacaaaaucgagaaaaacacaccgguacccaaaucgagcuggcaacuuagagucgacggccuugacagacagcuaaacgccgaagagugggcacgagugauauaccaccuaugcaaacaccgcggcuuccacuggauaagccgagccgaggaaaaagcagccgagggcgacagcaaaggggaaggcggaaaagucaagcaaggacuagcuggaacaaagaaauugaugcaagagaaaagcuaccggacagcagcagaaaugguccuagcugaguucccagacgcacaaagaaacaagcaaggagacuacagcaaagcgcucagcagaauacuccuaggcgaugaacucaaagcacuauucgaacaucagcgcaaacuaggaaacccugucgcaacagaaaaacuagaagcagcaauauuaggcaacggggacaagaaaugcggccucuuuugggcccaaaaccccgcccucgccggaaacaaacuacuagaaaugcucggacgaugcaccuucgagaaaacagggggcgaugacggcaaaggcgaauaucgcgcgcccaaagcauccuuuagcgccgagcgccacgucuggcucacgcacuuaaacaaccucagaaucgucgucgacggaacaaccagaccccucaacgaagccgaacggagagucgcacuacccaugcccuaccaacaagccggagaccucuccuacaagcaacuugggggagcccugaucaaagaaggguuccuccaaaaggacggauucaaguucgcaggccugcccuaccccaccaagcaagcauccgaagaaaaggcgaaggaccccgagacgucgguacuaugcaaacucccggcguggcacacucugcgcaaaacacucgaaaaacauggacuagaaucggaauggcaaaaauuaagcaccgacgccuuggacggcaaaccgcaacugcuagacaacauagccuggguccucucgguguauaaagacgacgacgaaguuaagaccgaacuagggaaauuaaaucuaccaaacacagaaaagaugauagacgcauugcucgacauccgauucgacaaauucaguaaccucagccuaaaagcccugagcaaaauaguaccguucauggagcaaggccaacgauacgacgaagcaguagcgaacauaccagaauacggacaccauucucaacuacauaaggugggggcgggcgagcauaaguacuugccacccuucuacaaagagagagacaaaacgggacgaaugguauucaaugaugacauggacauuccaagaaacccugugguccuucgcgcacucaaccaagccagaaaggucguaaacgcccucauaaaggaauacggcagcccgcacgaaguccacauugaaauggcgcgagaccucagccgaccacuggacgaacggcgagacauagaaaagcuacaaaaagaguucggagaacgaaacaagaaagacaaagaacucuucgcacaagacuuuaacauaguaggaacaguuaaagggaaacaauuugaaaaauaccagcuauaccgcgagcaacaaggcaaaugcaucuauccaucgauggacgaaaaacagggcauaugcuguuacucacucaaaccacucgaccuucacagagugcuauacgaagaaggcuaugccgagauagaucacgcccuacccuacagcaggagcuucgaugauuccaagaacaacagaguacucguccuagcaaaggagaacagagacaaggggaaccgcacgccauucgaauaccuaggggacaaagacaacucagagcccuggcgccaauucguagccuucgucgagggaaacaaggccuaccgauuagccaaacgcagucgccugcugcgaaaagauuucggcgauaaggaagccaaagaguuccgagaacgcaaccucaaugauacgcguuacauaugcaaguuuuucaagaacuacguggaacaauaccuucaacuucacgaagacagugaagccaagagaugcguuguccuaaguggacaaaugaccuccuuccuccgggcccgauggggucucguaaaaguccgaggggacucggaccggcaccacgcccuugacgccgcaguaguagcggccuguagucacggcaugguaaagagacuaagcgacuacucaagaagaaaagagcucgaacaagugcgcgagggguucgucgauguagacacgggagaaauagugaacccggccauguuccaacaaguacaggaacacuucccgaauccguggccgcacuuccgcgaugaaguaaaauugcgccucagcauagaugacccaacacugcuacgauccgaaauggaaaaguucggaacauacacaccagagucacuagaagcccuacgcccccuauucguaucuagagcgccacaacgaaggaacagcggcgcugcacacaaagacacaauauaugcgcaaccaaaacgccucguagcccaagggggaguaacgcagaaggucgcguuaagcagccugacccugaaagaccuagauaaacuaauagacccccaucgaaacgaacgacuauaugcagccauaagagccaggcuugaacaacauggcgggaagggagacaaggccuucccagccuccaacccccuacgaaaaccggacagcgaaggcaaccccacaggacccauaguacgaggcgucacgauggugaucgacaaacugagcggaauaccgauccgcgggggcauagcgaaaaaugacucuaugguccgcgucgacguauucaccaaagccaacaaguuccaccuagugccggucuacguccaccacagcguccuuggccuuccaaaccaggccauagugggcggcaaggaagaaagcgaauggacacaaaucgaugacuccuucgacuggcacuucucaaucuacccaaacgaccugauucguguuacacucaagcaggaaggccguuucggauacuacgccggaugcgaccgaagcacagccgcaauacaccuaugggcccacgaccgaaaccagcaaguaggcaaagacggccuaauacgcaguaucggcgucaaaaccgcauugucaaucgagaaauucaacgucgacguccucggcaaccgauaccccgcaccaccggagaaaagaagggaccuagccuga

SEQ ID NO: 7501 - RNA, 3486 nt, Artificial Sequence
  Cas9 variant
augaagaagauucuaggccuagaccuaggcucugccagcauagggugggcccucgucgaagagaccgaacaaaugcaauacaauaucguaagccugggaagucgaauaauccccuauaacggcaccgaaggccaggaauuugaaaaaggcaccggggaaucacgaaacagccuacgcacaaaagcgagaaccgccagaaaaggcuaugaccgcuaccagcuccgcaggaaaaaccuagagaaaauacugcuucagaacgguauguacccaaacgaacagguaagagcccuccagaaacucgagcucuggaaauugcgagcagacgcgcccaauguccagaucagccucccggaacuggggagacuccuauucuggcugaaccaaaaacgaggcuauaaaagcagccgauccgacgccaaucuagacaagaaagauacagaauacguagcgacagucaaaucccgccaccaaaagaucaaagacgcaggccagaccgucggacaguacuucuacggccaaauccucgagaacgaguaccaccgcauaaaagaacaaguguucccaagggaggccuacauugaggaguucgacgcaaucgucgcacggcaaaaggaauacuacccaacaauacuaaaacaagagcuaaucgacaaaauccgaaacgaagucauauacuuccaacgcggccugaaaagccagaagggcuuggucucaguaugcgaguucgaaggaagagaauuuaacggccacuucggcggccccaagguagcaccaaaaagcaguccgaucuuccaacuaggcaaaauaugggaaaacaucaacaacaucaaaauagcagacaucgaacugaccgcagaacaaaagcuaguauucuucaacuaccucaacugccacgagagaauuaccgaagcgaaaauccgggaacuacuaaaacuaucgaaagacagccggcuaaacggacagcucaaaaacggacugaccggaaacaagacauacucgcaaaucgcaaguugcuucggaaauaaaaucggugaguaugagagacuauucaaauucgagcucgaggucaucgaaagugaaaagcucgaauacaccuaccaccccaaaucucacauccccguaggcgaaaagcgacgcaaauacaucagcgaaaacgucgagaaggaacccuacuacagacucuggcacaccaucuacuccauuaaagacaaggaugaaugucgcgcggcccucauuaaaaacuucggcauagaagaagaaaucgccgagaagcucgccagccucgauuucagcgcuggggguuucggcaacaagugcgcaaaggugauaagaaaaauccucccauaccucauggagggcgacaaguacaacgucgccauggacuacgccggcuacaaccauagcuucucacagacgaaagacgagaaccuccagcgcguacuacuagacucaauaaaccaccuccccaaaaacucacuacgacaacccauaguagagaaaauucucaaccagaugaucaaccucgucaacgaggucauaaagcaauggggccgcccagacgaaauacgcgucgagcuggcacgcaaacuaaaacagucaaaaacugaaagaaacgaugacgacaacuuuaugcgcaaaagagaaagagaaaacgagauaaucaaagcagaccuagccaaguauggacucaaagcaacacgcaacaacgugaucaaauggcgucuguaccacgagaucgacgacaaagacaaaaagcuaaaugcacguugcauauacugcgggcaacccaucucguuaaccgaagccauacucggcaauaauguagacguagagcacauaaucccaaaagauaaacucuucgacgauagccagucaaacaaaacacuggcccaccgaagcugcaauagcggaaaggggaacaagacagcguacgauuucaugaaggauaaaccacaauucgaagaguacguagcccgcguugaagaacuauauaaaaagcaccugauaucccuaaccaagaaacgaaaauuccuaauguccgaggacaaaaucccaagcgacuucaucgaccgccagcucagagaaucacaguacauagcccguaaaucacgagagauucugcaaaccguaugcagaaacgucuggagcacagacggcggcguuaccgcccaccuccggaaacucuggggcugggacgacgucaccaugaaccuucaaaugcccaaauacaaggggaucggcaugacagaaaucguggagugggaauccaaucacggaaagaaccagcacacacaggaagucaucaaggacuggucaaagcgagacgaccaccgacaccacgcaauagacgcacuggugguggccuguacacgacaaggguacauacaaagaauaaauacacucaauagcagcgaaaccaaggacgagaugcaccgcaaaguagcgggcagcuuaguagaguucaaccaaaaacacacccuccucaacaaauaccuuauuacagaaaaacccuucaccacauccgaaguagaagauguggugagcaaaauucuagugucauucaaagccggaaagaaagcagcaacacccggaaaacgcaaagugggaaaacgggguaacaaacaggugguccaagacggcaucaucauaccaagaggcgcccuccacgccgacucggucaguggauccaucaaacaauacgacccaacgggcaacuucgaaaaccacaacguaauaaaauacaaaguggggguggguaagggcuaucucuucgacgggaaggacgacaagaagaaaauagacaaaaccauagacugcauagucgacaagaagaucagagaccucauaaaacaaagagcagaagaaucaaacuacagccugaaaaagauguucgaaaccccgauccuguucaaccagcgagcagucuucucuguccgcuguaaaacgggcaacaaagcaguagugccuauccgaaacggauacgugguacccgacaacaaccaccacaccgcgaucuacaaauacgacggagggcucaaggaacaaugcgucagccucaugcaagcgaucgaaagaaaacgauacaaccuuccgaucaucaucaaaaacccgaaagaaaucuacgacaagauaaccgagaucgcaaacaucaaccaacuacucuucgacagcuugccaaaacucgauugggaguucguaacaacgcuccaaaagaacgacauguucauacucggcauggacuacagcgcgaccgaagaggcacucgccgacggcaacuaccggcuccucucggaauaccucuauaagguucagaacauaagcgacgggaucuacaggcucugccaccacacgauaacuaaauuugaccuguccaaagcgaacaaaccagacaaacgauuuuacaauauccaaucccuaaaagccuggaacacacuaaacccccaaaagguuaaaauaaacauacucggccagaucgaacggcaguga

SEQ ID NO: 7502 - RNA, 3501 nt, Artificial Sequence
  Cas9 variant
augcacguagagauugacuuuccacauuucucacgcggagauucccaucuagcaaugaacaaaaacgaaauccuacgggggagcucaguacuguaucgacucggcuuagaccucggcagcaacucccuaggcugguucguaacccaucuagaaaaacgaggcgaccgacacgaacccguagcacucgggccaggaggaguccggauauuccccgauggccgagacccgcaaagcggcacaucgaacgccguggaccgacgcauggcacgaggggcccggaaaagacgcgaccgcuucgucgaacgacgaaaagaacucauagcggcacuaaucaaauacaauuugcugcccgacgacgcccgcgaacgcagggcacucgaaguacuggaccccuacgcacuaagaaaaaccgcgcugaccgacacgcuuccggcccaccacgugggacgcgcacucuuccaccuaaaccaacggaggggauuccaauccaauaggaaaacggacagcaaacagagcgaagacggcgcuauaaaacaagccgcaagccgccuagcuacagacaaaggaaacgaaacccuuggaguuuucuucgcggacaugcaucuucggaaaucguacgaagaccgacagaccgccauaagagcggagcuagugagacucggcaaagaucaccuaacgggcaaugcccgaaagaaaauaugggccaaaguacgcaaaaggcuguucggcgacgaagugcuacccagggccgacgccccacacggcguaagagccagagcaacuaucacaggaaccaaagcguccuacgacuacuaccccaccagagauaugcugcgagacgaguucaacgcgaucugggccggacagagcgcacaccacgcaacgaucacugacgaagcaagaaccgaaaucgaacacaucaucuucuaccaacgaccacugaaaccggcgaucguagggaaauguacccuugacccagcgacaagaccguucaaagaagacccagagggauaccgcgcaccauggagccacccacucgcacaacgcuuccgcauacuauccgaagcccggaaccucgaaauccgcgauaccggaaaaggaagccgaaggcuaacgaaagaacagagcgaucuuguugucgcggcccugcuagcaaacagagaagucaaauucgacaaacuacgcacacuccuaaaacucccugcagaggcacgcuucaaccucgaauccgaccgcagggcagcgcuugacggagaccaaacagccgcccgacucagcgacaaaaagggauucaauaaagccuggcgcggauucccgccagagcgacaaaucgcaaucgucgcucgccucgaagaaacagaagacgaaaacgaacuaauagcauggcuagagaaagaaugcgcccucgauggugccgccgcagcacgcgucgccaauaccaccuuacccgacggacacugcaggcucggacuacgagcgaucaagaaaauaguccccauaaugcaggauggacucgacgaagacggcgucgcgggggcaggauaccacaucgccgccaaaagagcgggcuacgaccacgccaagcucccaaccggcgagcaauuaggaagacucccauacuauggccaauggcuacaagacgcaguaguaggaagcggggacgcaagagaccaaaaagaaaaacaauacggccaauuccccaacccgacgguacauauaggccuuggccagcuaagacgcguagugaacgaccuaauagacaaauacggcccgcccacggaaauaucaauugaguucaccagagcccugaaacuauccgaacaacaaaaagcugaaagacagagagaacaacgaagaaaucaagacaaaaacaaggcacgggcagaggaacuggcgaaguucgggcgacccgccaaccccagaaaccuccuaaagaugcgauugugggaagaacuagcccacgacccacucgacaggaaaugugucuacacgggggaacaaauaucuauugaacggcuacuuuccgacgaaguggacauagaccacauccucccgguugcaaugacacuagacgauagcccagcaaauaaaaucaucugcaugcgauaugcaaaccgccacaagagaaaacaaacaccaucagaggcauucggaucaagcccaacucuucaaggccaccgguacaacugggacgacauugcugcgcgugccaccggcuuaccacgaaacaaaagauggagauuugacgcuaacgcaagagaagaauuugauaaacgaggaggcuuccuagcaagacaacuaaacgaaacuggcuggcuagcacgacuagccaagcaguaucucggugcagucaccgacccaaaccagaucugggucgucccagggagacucacauccaugcuacgcggcaaauggggccugaacggucuucugccuagcgacaacuacgcugguguccaagauaaagcagaagaauuucuggcaaguaccgacgacauggaguucucaggcgucaaaaauagagcagaccacagacaccacgcgauagauggacucguaacggcauuaaccgaccgcucccuacucuggaaaauggccaaugccuacgacgaagaacacgaaaaauucguaaucgaaccuccauggccaacaaugcgcgacgaccuaaaagcggcacucgagaaaauggucguaagccacaaaccagaccauggaauugagggaaaauuacacgaagacagcgcguauggcuucgucaaaccccuagacgcaaccggucucaaagaggaggaagccggaaaccuagucuacagaaaggccaucgaaucccucaacgaaaacgaaguagaccgcauaagagacauacaacuaagaacaaucgucagagaccacguaaacguagagaaaacaaaaggaguggcccucgcugacgcccugaggcaguuacaagcccccagugacgacuacccacaauucaaacacggccuucgacacguacgcauccucaaaaaggaaaaaggcgauuaccuuguaccaaucgcaaaucgugcgaguggagucgcauacaaagcauacagcgccggagaaaacuucugcgucgaggucuucgaaaccgccggcgggaaaugggacggugaggccguccguagauucgaugccaacaaaaagaacgccggccccaaaauagcacacgcgccgcaguggagagacgcaaacgaaggcgccaagcuaguaaugcgcauacacaaaggcgaucucauccgccuagaccacgaggggagggcaagaauaauggucguacaccgucuugacgccgcagcuggccgcuucaaauuggccgaucauaacgagacagggaacuuagauaaacgccaugcgacuaacaacgacaucgacccuuuccgguggcucauggcaaguuacaacacacucaagaaacucgcagcagucccagucaggguagaugaauuaggccgggucuggcggguaaugcccaacuga

SEQ ID NO: 7503 - RNA, 3507 nt, Artificial Sequence
  Cas9 variant
auggcaaggccagcauuccgcgcaccccggagggaacacgucaacggauggaccccggacccacacagaauaagcaaaccauuuuucauacuggugagcuggcaccuucucucccgcguggugauagacucaaguagcggcuguuucccggggacgagccgagaccacacagacaaauucgcagagugggaaugcgccguucaacccuaccgacucagcuuugacuuaggcacaaacuccaucggauggggccuccuuaacuuagauaggcaaggaaaaccaagagaaauccgggcccuuggaagccgcauauucagcgacggacgagauccccaagacaaagcaucgcuagcagucgcuaggagacucgcccgacaaaugcgaagaaggagagaucgauaccuaacgcgcagaaccaggcuuaugggagcacucgucagguucggauuaaugccagcagacccggcagcucgaaaaagauuagaggucgcaguggacccauaucuggcaagagaacgcgcaacuagagagaggcuagagccuuuugaaauaggacgggcacuauuucaucuaaaccaacgacgaggcuacaaaccaguaagaaccgcgaccaaaccugacgaggaggcaggcaaggucaaagaagcaguggagaggcucgaagcagcuauugcagcagcaggggcgcccacucuaggagccugguuugcauggcgaaaaaccagaggagagacacuaagagcgcgauuagcagggaaaggaaaagaagcagcauacccauucuaucccgcccgccgcaugcuagaggcagaguucgacacguuaugggccgaacaggcaaggcaccauccagaccugcugaccgcagaagcaagggaaauauugagacacaggaucuuccaucagcgacccuugaagccgcccccagucggcagaugcacacuauaccccgacgaugggagagcaccaagggcauugccgucagcacaaaggcugcgccuauuccaagaacuggcuagucuaaggguuauacaccuagauuugagugaacgaccccucacacccgcggaaagagacagaauaguggcuuucguacaaggaagaccaccaaaagcuggaaggaaaccggggaaaguccagaaaucggucccguuugaaaagcugagaggacuucuagaacuaccacccgguacggguuucagccuugaaagcgauaaaaggccggagcugcucggggacgaaacuggcgccagaauagccccggcguucggucccggcuggacggcccuaccccucgaggagcaagacgcuuugguggaauuacugcugacagaagcagaaccggaacgggcgauagccgcacucaccgcaaggugggcacuagacgaggcgacagccgcaaaauuggcgggagccacacuaccagacuuucacggcagguacgguaggcgggcaguagccgaacuacugcccgugcucgagagagaaacucgcggcgaucccgacgggagagugcgacccaucagacuagacgaagcagucaaauugcuacggggagguaaagaccacuccgacuuuuccagggagggggcccuacucgacgccuuacccuacuacggcgccguacuagaacggcacgucgccuucggcacaggaaauccagcagacccggaggaaaagcggguaggacggguagcuaauccaacagugcauauagcacugaaccagcuaagacaccucguaaacgcaauacucgcucgacacggucgacccgaagaaauaguaauagaguuagcacgcgaccuaaaaaggagcgcugaagacagaaggcgcgaagacaaaagacaagcagacaaccagaaaagaaacgaagaaaggaagaggcuuauacuaagccuaggcgaacgaccaacuccaaggaaccugcuaaaacuccgacuaugggaggagcaaggaccgguagaaaaccggaggugcccauacucgggagaaacaaucagcaugcgaauguuacucagugagcaagucgacauagaccacauucuccccuucagcgugagccuagacgacagcgcagccaacaaaguaguaugccugagagaggcuaaccgcauaaagcgcaaucgcuccccuugggaagccuuugggcacgacuccgaacguugggcagggauccuggccagagcagaagcguuaccgaaaaacaaacgauggagauucgcgccugacgcccucgagaagcuagagggagaaggcggcuuaagagcacgacaccuaaacgacacucgccaccucagccgcuuagcaguagaguaccuacgcugcguuugccccaaggugcgaguaagcccaggaaggcuaaccgccuuacucagaaggcgaugggguaucgacgcaauacucgcagaagcagacggaccaccgcccgaaguacccgcggaaacccuagacccguccccagcagagaaaaaucgagcugaccacagacaccaugcgcuagaugccgugguaaucgguugcauagaccgaucaaugguacaaagaguucaacucgccgcagcaucggccgaacgggaagcggcagcacgagaagauaacauacgucgcguacucgaaggcuucaaggaagaacccugggauggauuccgagcggaacuugaaaggagagcaagaaccauaguggucucacacaggccggaacacgggauaggaggagcacuccauaaggagacagcguaugggcccguagacccacccgaggaagguuucaaccuaguaguaagaaaacccaucgacggacucagcaaagacgaaauaaauagcgugagagacccaaggcugaggagagcacugaucgacagacucgcaauccgacggagggacgcaaacgauccugccacggcguuggcaaaagcagccgaggaucuagcagcucagccagcaagcagagggauccggcgcguaagagugcuaaagaaagagagcaaccccauacgcgucgagcacgggggaaacccaagcggaccacgcagcggagggcccuuccacaaacuacuucuagccggcgagguacaccacgucgacgucgcauuaagagcagauggucgaagauggguaggacauugggucacacuuuucgaagcacacggcggacgaggggccgacggagccgcagcaccacccagacucggagacggggaaagguuccugaugaggcuccacaaaggcgauugccuuaaacucgagcacaaaggcagaguacgaguaaugcaagucgugaagcucgaacccucaagcaacaguguaguaguuguagaaccccaucaaguaaaaaccgacagaagcaaacauguaaagauaagcugcgaccaacuacgggcccgcggggcccgaagggucaccguagacccccugggcagaguacgaguacacgcaccgggcgcgcgcgugggcauaggcggggaugcaggccggacagccauggaaccagcggaagacauaucguga

SEQ ID NO: 7504 - RNA, 3513 nt, Artificial Sequence
  Cas9 variant
augagcaaguacaacgugggccuggacaucgggaucgccuccgucggcuggagcaucguggacgccgacaagaagaagaucaucgaccucgggucccgcaucuucagcuccggcaacgcggcagccaaccaggagcggcgcggguuccggggcacccgccgccugauccgccggcgcaagaaccggcugaccgacgugaucaacuuuuucggcgagaagaaguucaucgacacgaaggucguggacaagaaugggcacgugcacuacaaguucuccgucaacaacaccgagucucccuacgagcuccgcgugaaaggccugagcgagauccugaccaagcaggagcucgugaucgcccuauaccacaucgucaagcaccgggggaucuccuacgaccugggcgaccucgaggacgacgggaccagcggcgugacggacuacaaaaccuccaucaacaucaaccgccagcugcugaacgagaagaccgugggccagauccagcucgagcgguuaaacgaguucggcaagguccggggccagguggaggagaacgagaacgugacccuguuaaacgucuucccgagcgccgcguacgugaaggaggccacgcagauccugaccaagcagagagaguucuaccccgagaucaccgacgacuucaucgccaaguucaugcuguucaucacccgcaagcgggacuacuucguggggcccggcaacgagaagucccgcacugacuacggcaucuacaagaaggacgggcggacccuugacaaccuguucgacgagcugaucggcaucgauaagaucaacggggagaagcgcgccagcgcguccagccucaccgcccagaucuacaacaugcugaacgaccugaacaacuuaaccguccccaacacggaggacggccggcugaccauccagaccaagaaggagauccuggaggccgccaagacaaccaacgggcuguucggcauagcccagauaugcaagaucaucggcugcaagaaggacgacaucaagggguuccgcaucgacaaguccgagaagaagaucaugcacacccugagcggcuaccgcaaguuccggaaggaguuagccgacgugaacaucgaggccaacgaccucaacaucaaccuggugaacaagaucgccgacauccugacccucaacaccgagaaagccgagauccgcaagcagcuugacaaguccaacauggacaucagcaacgagaugaaggagaucgucaucaacaagaacaaggaguuccugguggacgggcgggccacguggcacagcuucuccuacaagacccucaaccugcugaucccggagcuccugaacacccccgaggagcagaugaccaucuuaacgcgccucggccuggugaagcccaacaacaagaaguacgaggggcugaagaacauccccgcgcggagaaucacggaggagaucuacaacccggucguggcccgggccacccgcgaggccgucaacgucuucaacgccaucaccaaaaaggucgggcgggacaacaucaaggacgucaucaucgagcucccccgcgaggacaacgagguggacauaaagaagggaaucgugaagcggcagaagcagaacgaggucgagaaggagacggcagacgccuuagugaagcagcacaugaccaucagcgacuccgcccugaucgcccaguaccgcaagauccgggggcucagccagaaggugcgcuacugguaccagcaggacaccaucugccccuacugcggcaaaaagaucgaagccguccaacugaucaacaacaacgacuccuucgagguggaccacaucgugcccaucagcgucuccuucgacgacagccagaacaacaaggugcuggugcacucacagugcaaccaggccaaggagaagcagaccccgcugggguggcucaacaacggcgggggcuucggccagagcaaggccgacuacaucgcccgggucaaguccaacaagaacuacgccaagaacaagaucgacaaccugcugaacgagacggaccucaacgacaucgcgacccagcgcggguucauccagcggaaccugaacgacacccgcuacgccagccggaucgugcugaacgaguucuacucauucuuccgcagcaacaaccucuccaccaaagugaagguugugcguggcaaguggaccagccagaugcggaagaaguggaacggggugggcggccuguccaaaacgcgcgauaccuaccaccaccacgccaucgacgccugcaucaucgccugcuucccccugcuaaaggcguucgacaaggccauuaagcugaucgacgucgacggggagaccggcgagauucugcaggacaaaaaggccaucaagcucgcccaggaggccgagaucguggagaaaauaagcgugaucaagaacaagaaguucgagaacauggucaacgagaucuacaacuucccccuguucaagcaggucgagcuggcgaacgacaucaccaaccucgagaaccccgugaaguucucccaccacguggacaagaaggccaaccgggccguggccaaccagacgaucuacggaacccgcaucaaggagaaggaggugaccaagcggggcaagaaggagaagauccaggagcgcuacacccuggggacgaucaagaacaucuacgacaucgacggcuucaugaacuucaagaagcuguacgacaagaucagcaaaaacgacgacgucaaguuucucaugcagaagaacgacccgaagaccugggagaagcugaucgacaucuucaacagcuaccccgacuccgaggaggugacccagguggacggcaaggucaagcggguggccgugagccccuucaaguuauacuaccgcgagaacggguucaucaccaaguacuccaagcacaacgacggccccaaggucgugagcaucaaguacuaugacuccaagguggggagccacaucgacaucacgccgaaggacgcgcggaacaaggucauccuccagucccugaagcccuggcgcaccgacguguacuucaacagcaucacccagcaguacgagcugcucggccugaaguacuccgaccugaaguucaccaacgggguguacggcaucacgcgggacgccuacgagaaacucaagcacggcgucagcgaggacggggugaccgccuggaagcccaucuccaagaacagcgaguuccgcuucucccuguaccggaacgaccgcgugcgggucaucgacgagaagggcgacagcaucgagcuccucuucgccucccgcaccacuagcaacgaaggguacguggagcugaagcccaucuacaaggcgaaguucgacucaaaggaggaggugggcuuuuacgggcuggucagcaacggccggcucaucaagaagaugagcaagggcggguacaagcuguacaagguaaacacggacauccuaggcaagccguacuacgugacgcgcgaguccgacgagcccaagcucagccuguga

SEQ ID NO: 7505 - RNA, 3516 nt, Artificial Sequence
  Cas9 variant
auggcuaaguacagcgugggccuggacaucgggaucucuagcgucggcugggccaucaucgacauagagaccaagcagaucgugaaccucgggucccgcauuuucccuagcggcaacgcggccgggaaccaagagcggcgcggcuuccggggcauucgccggcugauccgccggcgcaagaaccggcugaccgaccucaagaagcuguugggggagacguucuucuccgaccuuaagaaaauugacagcaacggcuacgaguacuacgacaucgacuuccagaucaacgccaacccguacgagcugcgcgugaagggcaucacugaaaaacuuuccaagaaggagcucgccgucgugcugcaccacaucaucaagcaccggggaaucagcuacgaccugggggaccucgaggacgacggcaccuccggcgugagcgacuacaagaacuccaucaacaucaaucgccaauuacugcgggagaagaccgucgggcagauucagcucgagcggcuuaucgaguucaaccaagugcacggccagguuaagaaggccgaggacgucagcuuacucaacguguucccguccagcgcguaccgggacgaggccaacaagaucaugaucaagcagcaggaguucuacuccgagaucacgaacagcuucauggagcaggucgaccagcuggugucccguaagcgggacuacuucaucgggcccggcaacgagaagucccgcaccgacuacggcaucuacaagagcgacgggcggacccuggacaaccucuucgccgagcugaucggcaccgacaagaucaacggggagaagcgcgccagcgcuagcucccugacggcccagguauacaaccucuugaacgaccugaacaaccuccacgugagcaacaccgaagacggcaagcugaccaccucaacgaagaaggagaucaucaaggccgccaagaccaccgacgggguauucggcaucagccagaucugcaagaucaucggcugcaagaaggaggagaucaccggguuccggcaggacaaguccgagaagaaggugauccacacgcuggccggcuaccggaagauccgcaaggcgcucgccaccaucaacaucgaagccaacgagcugaaccccaccguuuucgaccagauagccgacauccugacucucaacacggagaaggccgagauccggaagcaguuagacaaggugcagcuggacaucaccgacgaaaugaaggaguuagugaucgacaagaacaaggacuuucugguggacgggcgcgcgaccuggcacagcuucucauaccagacgcugaacaugcucaucccggagcuucugaacacgagcgaggagcagaugaccauccucacccggaugggccuuaugaagucugacaacgagaaguacagagggcugaagaagaucccugccgagaagauagccagcgagaucuucaaccccgucguggccaaguccacccgggaggccaucaagguguucaacgcgaucagcaaggagaucggcaagaacaacaucgagcacguagugaucgagcucccucgcgaugauaacgaagaggaugagaagcggaagauccagaagcugcagaaggccaacgagacggaaaaggaggccgccgacaaccuggucaagcacaaauuaggcaucuccgacagcgcccugaucgcgcacuaccgcaaguucaaggggcugucccagaaggugcgguauugguaccagcaggagaccuacugcccguacugcgggaagaucaucgaggccacucagcugaucaacaacaacgacaacuuugaaguggaucacaucauccccauaagcgucuccuaugacgacagccagaacaacaaggugcucguccacucccagugcaaccaggccaaggagaagcagacgccccugggguggaucaacaacggcgggggcuucggccagagcaagaacgaguacaccaaccgugucaagaacaacaagaaguacagcaagaacaagguggacaaccugcuaaacgaaaccgaccugaccgacaucaucacucagcgguccuucauccagcgcaaccugaacgacacgcgguacgccgcgcgcaccgugcucgacgaguucuacagcuucuucaaguccaacgaccugcccaccaaggucaaggugguucggggaaaguggaccagccagaugcgccggaaguggaacaacgucggugggcuccgcaagacccgggauacgcaccaccaccacgccaucgacgccuccaucaucgccagcuucccgcuccugcgcgccuucgaccgcgcgaucaagcugaucgacguggacaaggagacaggcgagauugugcaguacggcaaggccucccucaacggggacgucaucgaggagaaguccgugauccaggcccccaucaucaagaacgagaaguucgagaagcugguggaugagaucuacaacuucccccuguucaagcagguagagcucgccaacaacaucgagaauccagagaacccggugaaguucagccaccacguggacaagaaagccaaccggaccgucgcgaaccagaccaucuacagcacgcgcaucaagaagaccgagaagaucgugcggaaaaaggugaccgccaaagaagaggaauacgucaucggcacgaucaaggacaucuacgacgugacaaacuucgagaaauucaagaagcuguacgacgaauccagcaagaaggacgacaucaaguuccugaugcagaagaacgacccuaagaccugggagaagcucguugagaucaugaacaccuaccccgauuacgaggagaucucccagcuggacgggaaggucaaacgagugaagguaagccccuucaagcuguacuuccgggagaacggcuucaucaccaaguacgccaagcacaacaacgggccgaaggucgugucaaucaaguacuacgacagcaaacucggcaaucauaucgacaucacgcccguaaacgccaacaacaagguaauucugcagucccugaagcccuggcgcaccgacguguauuacaacaacgagacccagcaguacgagcuccugggccugaaauacagcgaccucaaguucaccaagggaguguacggcaucacgcgggaggccuacgaaaagcugaaauacggguacaccgacggcguccccgcguggaaacccaucucuaaggaguccgaguucaaguucagccuguaccgcaacgaccgggugcgcaucaucaacgaggccggggagaagaucgaccuccuguuuggcucccggaacgagaccagcgagggcuacguagagaugaagcccaucuucaagacgaacuucgacgacgccgaggaggccucuuucuacgggaagacgagcaauaagcgccugaucaagaaaauggcccggaagggcuaccagaucuacaaggucaacaccgacauccuagggaaccuguacuacacggccaaggaguccaacgaacccaagcuggaccuguga

SEQ ID NO: 7506 - RNA, 3519 nt, Artificial Sequence
  Cas9 variant
augcgcaagcccuacagcaucggccucgacaucgggaccaacuccguggggugggccgucaucaccgacgacuacaaggucccgagcaagaagaugcggauccaagggacgaccgaccgcacuuccaucaagaagaaccucauaggcgcccugcuguucgacaacggggagaccgcggaggccacgcggcugaagcgcaccacccggcgucgguacacccgccggaaguaccgcaucaaagagcugcagaagaucuucagcuccgagaugaacgagcuggacaucgccuucuucccccggcucagcgaguccuuccuggugagcgacgacaaggaguucgagaaccaccccaucuucggcaaucugaaggacgaaaucacguaccacaacgacuaccccaccaucuaccaccuccgccagaccuuggccgacuccgaccagaaggcugaccugcggcucaucuaccuggcgcuggcccacaucaucaaguuccgcggccacuuccucauugaggggaaccucgacagcgagaacaccgacguccacgugcuguuccucaaccuggugaacaucuacaacaaccuguucgaggaggacaucgucgagacggccuccaucgacgccgagaagauccucaccagcaagacauccaagagccggcgccuugagaaccugaucgcggagaucccgaaccagaagcgaaacaugcuguucgggaacuuagugucccuggcccucgggcugacccccaacuucaagacgaacuucgagcugcucgaggacgccaagcugcagaucagcaaggacuccuaugaggaggaccuggacaaccuccuggcccagaucggcgaccaguacgcugaccuguucaucgcggccaaaaagcucagcgacgcuauccugcuguccgacaucaucaccgugaagggcgccagcaccaaggcgccccucagcgccuccaugguccagcgcuacgaggagcaccagcaagaccuggcccugcucaagaaccuggugaagaagcagauccccgagaaguacaaggagaucuucgacaacaaggagaagaacggcuaugccggcuacaucgaugggaagaccagccaggaggaguucuacaaguauaucaagccgauccugcucaaacucgacggcacggagaagcugaucuccaagcucgagcgggaggauuuccugcgcaagcagaggaccuucgacaacgggagcaucccccaccagauccaccugaacgaguuaaaggccauuauccgccgccaggagaaguucuaccccuuccucaaggagaaccagaagaagaucgagaagcuguucaccuucaagauccccuacuacgugggcccgcuggccaauggccaguccagcuucgcguggcucaagcggcaguccaacgagucaaucacccccuggaacuucgaggaggucgucgaccaggaggccuccgcccgcgccuucaucgagcggaugacgaacuucgacaccuaccugcccgaggagaagguguuacccaagcacaguccgcucuacgagauguucauggucuacaacgagcugaccaaggugaaguaccagaccgaggggaugaagcgccccguguuccugucuagcgaggacaaggaggagaucgucaaccuccuguucaagaaggagcggaaggucacggugaagcagcugaaggaggaauacuucuccaagaugaaaugcuuccacacugucaccauccucggcguggaggaccgcuucaacgccagccuggggaccuaccacgaccugcucaaaaucuucaaggacaaggcguuccuggacgacgaggcgaaccaggacauccuggaggagaucguguggacgcucacccuguucgaggaccaggccaugaucgagcgacgccuggucaaguacgccgacguguucgagaaguccguccucaagaagcucaagaagcggcacuacaccggcugggggcgccugagccagaagcucaucaacggcaucaaggacaagcagaccggcaagacgauccugggguuccugaaggacgacgggguggcgaaccggaacuucaugcagcucaucaacgacuccagccuggacuucgccaagaucaucaagaacgagcaggagaagaccaucaagaacgagucccuggaggagaccaucgccaaccucgccgggagccccgccaucaagaagggcauccugcagagcaucaagaucgucgacgagaucguuaagaucaugggucagaaccccgacaacaucguuaucgagauggcgcgcgagaaccaguccaccaugcagggcaucaagaacagccggcagcgccugcggaagcucgaggagguacacaagaacaccgguuccaagauccugaaggaguacaacgucagcaacacacagcugcaguccgaccgccucuaccuguaccugcuccaggacgggaaagacauguacaccggcaaggagcuggacuacgacaaccugagccaguacgacaucgaccacaucauuccgcaguccuucaucaaggacaacagcaucgacaacaccgugcucaccacgcaggccuccaaccggggcaagagcgacaacgugcccaacaucgagaccgucaacaagaugaaguccuucugguacaagcagcucaagagcggggccaucucccagcgcaaguucgaccaccugaccaaggccgagcgaggggcccucagcgacuucgacaaggcgggcuucaucaagcgccagcugguggagacccgccagaucaccaagcacguggcucagauccuggacucccgguucaacucgaaccucaccgaggauuccaagagcaaccgcaaugucaagaucaucacccucaagagcaagaugguguccgacuuccggaaggacuucggcuucuacaagcugcgcgaggugaacgacuaccaccacgcccaggacgccuaccugaacgccgucguggggaccgcgcugcugaagaaguaccccaagcucgaggccgaguucguguacggagacuacaagcacuacgaccuggccaagcugaugauccagccugacagcucccucgggaaggccacgacccggauguuuuucuacagcaaccugaugaacuucuucaagaaggagaucaagcuggcggacgacaccaucuucacccgcccgcagaucgaggucaacacggaaaccggcgagaucgugugggacaaggugaaggacaugcagaccauccggaaggucauguccuacccccaggugaacaucgugaugaagaccgagguccagacgggcggguucagcaaggaguccaucuggcccaagggugacagcgacaagcucaucgcccgcaagaaguccugggaccccaagaaguacgggggcuucgacucaccgaucaucgccuacagcgugcuuguggucgccaagaacugcaagcggaagaacagcaagaccaagaacuaccagcggaccugcgggaacaagaacaacggcacucgguga

SEQ ID NO: 7507 - RNA, 3522 nt, Artificial Sequence
  Cas9 variant
augaggccaaucgaaccuuggauacuaggacuagauauuggaacagauucguugggcugggcaguguucucuugcgaagagaagggcccaccaaccgcaaaagaauuacucggaggaggagucagacuauucgacagcgguagagaugcgaaagaccacacaucacggcaggccgaacguggagcauuccgacgagcacgcaggcaaacccgcaccuggccauggcgaagagaccgacugauagcacuguuucaagcagcaggccuaacgcccccugcagccgaaaccagacaaauagcgcucgcccuacgacgagaagcaguuagucgcccacuugccccagacgcccucugggcagcccuacuccaccuggcgcaccaccgaggauuccgcucaaaccgaaucgacaaaagagaacgagcagcagccaaagcacucgccaaagcaaaaccugcgaaagcgaccgccaaagcaacagcaccagcaaaagaagcagacgacgaagcaggguucugggaaggggccgaagcagcgcucaggcaacgcauggcagccucaggagcgccaacugucggagcccuacucgcagacgaccuagaccgcggccagcccguccgaaugcgcuauaaccaaucggaccgcgauggaguaguggcccccaccagggcgcuaaucgcagaagaacucgcggaaauagucgcaagacaauccucagcuuauccaggccuggauuggccggcaguaacccgacucguccuagaccaaagaccccuccgauccaagggcgccggcccgugcgccuucuugccgggagaagacagagcacucagagcacuuccaacuguccaagacuucauaauccgccaaacgcuggcaaaccugcgacuacccuccaccucagccgaugaaccccgaccccuaacggacgaagaacacgcgaaagcccuagcccuacucucaacagcacgcuucguagaauggccagcacuacgacgagcccuaggccucaaaagaggcguaaaauucaccgcagaaacagaaagaaacggggcaaagcaagcagcacgcggcacagcagggaaccuaacggaagcaauauuagccccacucaucccggggugguccggaugggaccuagaccgcaaagaucggguauucagugaccuaugggccgcgcgccaagaucgaagcgcacuguuagcauuaaucggagacccacgaggcccaacaagggucacagaagacgaaacggccgaagccgucgcagacgcaauccaaaucguacuacccaccggccgagccagccuauccgccaaagcagcccgggccauagcccaagcaauggcccccggaauaggauacgacgaagccgucacccucgcccuagggcuccaccacucacauagaccgcggcaagagcgccuagcacggcuaccauacuacgcugcagcacuccccgauguaggccucgacggggauccaguaggaccuccacccgcagaagacgauggcgcagccgccgaagcauauuacggccgcauuggcaacaucagcguccacauugcccuuaacgaaacaagaaaaauagucaacgcgcuacugcaccggcauggcccaauacuaaggcuagucaugguagaaacgacccgcgaacugaaagcaggagcagacgaacggaaacggaugauagcagaacaagccgagcgcgaacgugaaaaugcagaaauagacgucgaacuccgaaagagugaccguuggauggccaacgcaagagaacgaaggcaacgcguaagacucgcacgcagacagaacaauuuaugcccauacacgagcacaccuaucggacacgccgaucuacuaggcgaugcauacgacauagaccacgucauaccccucgccagaggaggacgcgacucacuggacaauauggugcuaugccaaagcgacgcaaauaaaacuaaaggcgacaaaacgcccugggaggcauuccacgacaagccaggcuggaucgcacaacgcgacgauuuccucgcacgccuagacccccaaacagccaaggcccuugcauggcgcuuugccgacgaugcaggagagagaguggcaagaaagagcgcagaagacgaagaucagggcuuucuaccacgacaacuaacggauacaggauacauagcaagagucgcucuccgauaccugagucuaguaacaaacgaaccaaacgcagucguagccacgaauggcagacuaaccggucuccuccgauuagccugggacauaacgccgggaccagcgccccgggaccuccuaccuacgccacgcgacgcauuaagagacgauacagcugcgcgacgguuccucgacggacuuacaccgccaccccuggcuaaagcagucgagggcgccguccaggcacgacuagccgcccuagggagaagucggguagcagacgccggacuagcggacgcacuaggccuaacgcuagcaagccucggcggcggcggcaaaaaucgagccgaccaucgacaccacuucaucgacgccgccaugauagccguaaccacuagaggacucauaaaucaaauaaaucaagcguccggcgccggacggauccuagaccuaaggaaguggccccgcacaaauuucgaacccccauacccaacguucagagcagaagucaugaaacaaugggaccauauacacccaaguauucgaccagcacaccgcgacggaggaucccuacacgcagccaccgucuucggcguuaggaacagaccagacgcacgaguacucguccaaagaaaaccaguugaaaaacuguucuuagacgcaaaugcaaagccacucccggccgacaaaauugccgaaaucauagacggauucgcauccccgagaauggcaaaacgauucaaagcccuccuagccagauaccaagccgcacauccagaaguaccuccagcacuggcagccuuagcggucgcucgugacccagccuucggacccagaggcaugacagcaaacacaguaauagccgggagaucagacggagacggcgaagacgccggacuaauaacgcccuucagagcaaaccccaaagcagcaguacguaccaugggaaacgcaguauacgaaguaugggaaauacaggucaaaggccgaccccgcuggacccacagaguacucacacgcuucgacagaacacagccagcacccccuccgccacccgagaacgccaggcuaguaaugcgacuccgacgaggagaccuaguguacuggccccuagaguccggcgaccgccuauucuuaguaaagaaaauggcgguggacggacgccucgcacuguggcccgcccggcucgcuaccggcaaagcaaccgccuuauacgcccaacuaucaugcccuaacaucaaccuaaacggagaccaaggcuauugcgugcagagcgccgagggaauacgcaaagaaaagauucgaaccacuagcugcaccgcacuaggaagacuacgccugucuaagaaagcaacauga

SEQ ID NO: 7508 - RNA, 3525 nt, Artificial Sequence; identical to SEQ ID NO: 1708
  Cas9 variant

SEQ ID NO: 7509 - RNA, 3528 nt, Artificial Sequence
  Cas9 variant
auggaggagaugaagcagaccggccgcaagaacgaggcccccaagcugaccgaccucaacuaccggaucggacuggacaucggcaucgccucaguggggugggccguccuggagaacaacucccacgacgagccguuccgcaucaucgacuuaggcguacggauauucgacacggccgagcagcccaagaccggggccagccuagcccugccccgccgggaggcccgcuccgcgaggcgccggauacgccgacgccgggaccgcaucgagcggauaaagaagcuguuccaggccgagggccuuaucaacaucgacgaguucgaggcccgcuacaagaucgcuggccuuagcgacguguacaagcuccgguacgaggggcuggaccgcaagcugaccgacgacgagcuggcgcagguccugcugcacaucgccaagcaccgcggcuucaaguccaccagcaaggccgaggaggccgagaacgagaacgacgccgcgaagaagaaggaggccggggcccucaagaaagguaucaguaacaacaagaagcuaauggaggagaagggguaccgcacggugggcgaaaugauguaccuggacgagaacuuccggaccgacugccccuggaacgagaacggcuacauccucaccccgcgcaacaagagcggggauuacaaacacaccgugcugcgcgacaugcuggucgacgaggugagggagaucuucaagucccagcgcagccucggcaacauccacgccucagaggagcuggagaacgccuaccuggacaucaugcugucccagcgguccuucgacauggggcccggggcgcccagcaaguacgccauggaaggcuucgaagaucgcguggggcugugcacguucgagggcaagaauggggagaagcgugccgccaaggccgcguacaccuccgagcuguucguggcccucgagaagaucaaccacaccaaaaucgucagcgacgacggcgccacccgcuuccuuacgaccuaugagcggaaguccaucaucgagcugaugcacaagcagcagaccgugaaguacgccgccguccgcaaggcgaucgggcucgccgaggaggacaaguuuuacaaccugaauuacagccccaaggccggcuccaagaaguccccggaggacacggacuucgugaagcuggagaacuaccacaaaauccggaaagcucucggcgaggacaucgugagcgagcaccuccccgcggagaagaucaaacuguacgacagcaucgcuacgauccuuacccuguucaagaaugacgacucacgcaucaagcgguucaucgagcuggguaucggagaggagugcuucgacggguuacugucccugagcccauccaaauuucauaaccucucguuagucgccaugggcaaaauuauccccuuccugcucgacgggaacaccuacgacaaggccugcgagcuggccggcuacgacuuuaaagcugacaacaagggcgagaaguccgugcugcucaaggggaagaacaucaccgacaugguaaacgacaucacgaacccggucguccgacggagcgugucccagaccaucaaggucaucaaugccaucauacuggaguacggcagcccccaggccgugaacaucgaguuagcccgcgagauguccaagaacuucgacgagcgccgcaagcucaagagcgacauggagucccgggagaaggaaaacaacaacgugaucaagcgcgucaaggaguacaaacuuaaccccaccgggcaggacauagugaaguuccggcugugggaggagcaggaccgccgcugccuguacagcggcgaaaagaucgacaucaaugaccucuucucccgggauggcggguacgacgucgaccacauccugcccuacagcaucaccuuugacgacacguaccgaaacaaggugcuggucaaggcauccgagaaccggcagaagggcaaccgcacccccuacgaguacuucauggcagagaaagacgacgacgaauggaacgucuaugagacccucgugcggaacaccguuaaggacuacaagaagguccugaagcuacucaagaagcacaucacggaggacgagaaguccgaguuucgcgagcggaaccuaaccgacacuaaguacauuacucgcaucaucuacaacaugauccggcaaaaccuggugcucaagcccuaccugagccuggagaaggagcgcaagaaacaggugauggccgugaacgggaguaucacgcacuaccucagcaagagguggggguuggaguccaaggaucgccggaccgacacccaccacgcccaggacgccgucgugaucgccugcaccacggaugggaugaucaacaagauuagcagguacuccaaggggcgggagcugcuauacagccgcggcuucaaguucguugacgaggaaaccggugagauccugucccgggacaacuucacacgcgaggagugggacgagaaguauggcgugaaaauccccauccccugggagcacuuccgggacgagcuggacauccgcaugagccgguacaacgggaccggcgacgacaguaucgacaagaccacgccgcgcgacuucauccucagccaccgagaugcgcacaaguggaucaacuaccccgaguggauguucguggaggggcggcccggccgccggggcguccuggacggcaucuucgugucccgcaugcccaagcacaaagugagcggccaggcccacgaggagaccguccgguccgccaaguacuacaacgacgggggcagcguguucgaguccgggggcuacguggucaccaagaagucgauccaggacaucaaguuaaaggacggcgagaucaaggaguucuucaacccggacagcgaccgccuccuguacaacgcccugguggaccggcucaacaaguucgagaacgaccccaagaaggcguucgcugagcccuucuauaagcccaaggccgacgggacccagggccccaucgugaaaaagaucaagguuuucgagaagcagagcuccggggucuucgugcgcgacggcaaggggaucgccgccaacggcgcgaugguccggaucgacguguucugcgaggaggacaagggcaagaagaaguacuacuucguuccuaucuacacggcagacgucgugaagaagaagcugcccgaccgcgccgccaccgccaacaagcugaucagcgaguggcgagugaugaaggaggagaacuucaucuucagcuuguacucccgcgaccugaucuacaucgaaagcgacaaggggguccagguaaaggacaucgacggcaagaucuccaagccggugaaccucuucgcguacuaccucggggccgauaccagcaccgccuccaucucuggcaagcuccacgacuccagcgccaacuuccggaguaucgggauccagggccugcgccgguucgacaagugucaggucgacgugcucggcaacaucagcuucgugaacaaggagaagcgcaugcccuucaacuga

SEQ ID NO: 7510 - RNA, 3531 nt, Artificial Sequence
  Cas9 variant
augaacaagguccaggaggacugcuacaagaagaucaaggagaagcuggccgaccgcgaguaccggaucggccucgaccugggggucggcagcauaggguacgcgguggugucccugaagggcgacaugcccgaggacgugauccucgcggggagccgcaucuucaaguccagcaucggcgccgccgagcggcgccacuuccgggcccagcggaacacccaccggcaccaccgcgagcggaugcgcuaccuauggaagcugcucgccgagaagaaccuggcguugcagcucccggagaaccuguccaagaaggagaacuucaccgacuucgacaccagccgcaagcgcuuccccaucgaggugcugcggaacgaccccuacauccuccgcuacaaggcccuggacgagaagcugucccucuuccagcugggcuacgcccuguaccacaucgcuaaccaccgggggaccgcgagcgugcgguccuuccucgaggacgacgaagccaaggugaaggagaacaaggagaccgccaagcuagccaaaaacaccaagaagauaauguacgagaagaaguaccggacguucggcgaauaccuguaccgcgaacggaucgagaaguucagacagaacgaacgaaugaaggugaccaauaaaaacgagaacaaggaguucgcugugacccgcgacaucaucgaaaaggaggucgagaugauccucggggcgcagaaacgcuacaauaccgccgugcuggccgacgacuacauagagcguaucaagaaagccaucuucuacgagacggagaagcugauccccgagccggaguacugccccuacuucaaggacgacaagcgccucccccggagccacaagcucaacgaguaccgccgcaucuacgaggcccugaacaacacccgcuacuacauccccgagaucgaggagaagaccggcgagauccucucccggaaggagaaagagcaguuaagcaaggaggagaaggagaagcuguucaacuuccuucugaagaacaaggaacugaccgaggcgaaggugaagaaacuccugaaccuguccgaaauggccaagguccaguugcaggggagagacaaaaagaaccagaagaucaagggcuacgcucugaucacgcucgagagccucccguucuggucaaagcugcccgaacaacagcaggacgaguuccuguacgacuggaacaagcuccccgaugagaagcugaaggaccgccugcgcaacuacuacaagcucaccgaugacgagaucgacgagaccuuccagaacaucgugcugcccagcaacuacgccccgcugggcaagaaggccauggagauccuccuggaguacauaaagaacgggcugagcuacaucgaggcgcuggacaaggccgccgacgagaacaagauaaaaguggagaagcacgagaucaacgaucuccugcccuacuacggcaagauccugcaggagagcacccagaugccuaucgggaaagccuucuccaagcaguucgccgcgaagaacuacaagaagccggacaucaauaagaacgagcaggaguucggccggaucgccaacccggucgugcaccagacguugaacgaguugcgcaagcugaucaacgaaaucaucacgguguucggcaagaagccccucgagaucagccucgagaccagccgggagcugaagaagucccagaaggagcgcgagcucaucgccaagcagcaggacaucgacgaggagaagaggaagaagaucuggaagaccuacaucgagccacaccuccagcagaucaagagccgcuccgacaagcugaagaagcuguuugucuucgaguugugggaggaccagaagcacaacugccccuuuugccuggagaagaucaacguugacgacaucuacagccgcgggguggacaaggagcaccucuucccgcugaagaaguccgaagacgacagcgagaacaaccuggucaucgcucacaacaagugcaacgcgaggaaggcagagcgggcccccuucgacgccuucggacacgaguccaucuggaacgacauauucagcaacgccgagaagaaccucccccgcaaguuauggagguuucggcagggguccuucgagaaguuccuagagaaacccccgaugcucaagcgcuucgaaacggacaacagcuacaucuccaagauuagcgcgcgguaucuggccugccuguucgacaagcccaguaagaucuucugcgugaagcccuuccucaccgcccagcugcgcaucgccuggcagcuggacgaaaucaugauccgccuggccgagaacaucauuuuggacagugaaaaagacuccuuuaacaagggcgggcugcagaagaagaagcgcaucgacaaccggcaccacgcgcucgacgccguggucaucgcuuacgcaucgcgcggcuaccacaacuuccugaaccgggugcacgccaagggcuacaagaucaacuacgacgagaagaccuggcuguccgagacccuccggccaccgggaaacaagaaccuggaggacuucaagagcggaaucaucaacgucaugaucaacgcgaacaucuccaucaagcacgaccacaacaacaaggggcagcuggucaagagcaaggccuauaagcucuacuacagcgaaaucggcaaauacaucaucacgacccugaaguccgugagcgagauccuguucaagcagaaggaaaaaccccaggacacccuccggcgcgcccugugcaaguucgaggaucgucuguccgauaucaaggacaagaaacuccgcaagaagcuggaggacaacaucaccaucuacaagagcaucgagaacgaguccgcccugagcaaggcgaagcaggagcucgaggaguucgaccugaaggcaaagaaggaggggaagaagggcuacgagaagaucacggacauccugaucuacaagaaggccugcuccaugcacggcgggaaguacauacacgugaagaaccggaucgaaaacaaauuuuucgcccucaaggaacccaccgagaucgaaaccggcuucggguaugacacggccgacaacuuaucccuggaccucuaccacgauaacaacggcaagcugugcggggaggugauccggaagaucgacuuuaacagaaaccgcgugccgaacuacaagaaggagggcuacauacuccucgagcggaucuaccagggcgacacacuggaggucgacaucuccgaugacaagaucucacuuaagaauaaggugggguccgcccccgacaagcggaccuucgugaagguccucaccuucaccgagagcgaccgguaucugaagaacaagcgcgaccagauccagaucuucuucugcaaccugcucaaguccacgcugaagcacgacgacagcuccaagcacgacgacagcuucuacguguccagcaugcagaaguacaaugugcgcaaagucauccugaccagccucggcaucaucaaguaccgcucgaagauccugaagaacaaggagaucuga

SEQ ID NO: 7511 - RNA, 3531 nt, Artificial Sequence; identical to SEQ ID NO: 1711
  Cas9 variant

SEQ ID NO: 7512 - RNA, 3534 nt, Artificial Sequence; identical to SEQ ID NO: 1712
  Cas9 variant

SEQ ID NO: 7513 - RNA, 3540 nt, Artificial Sequence
  Cas9 variant
augucaaagaaaguuagcagacgcuacgaagaacaagcccaggaaaucugccagagacuuggcagccgacccuacucgauaggacucgaccugggcguaggcaguauaggugucgcagucgcagccuacgaccccauuaagaaacaacccuccgaccuagucuucguaucaagucgaaucuuuauccccuccaccggcgccgccgagcgacgccagaaaaggggccaaaggaacucucucagacaccgagcaaaccggcucaaauuccuguggaaacugcuagcagaacgaaaccucauguuaucguauuccgaacaagacgucccggacccggcacgccuccgcuucgaagaugcagucguuagagccaacccauacgagcuaagacugaaaggccucaacgaacaacucacacugagugaacucgguuacgcacuguaccacauagcaaaccacagaggcuccagcaguguccgaacauuuuuagaugaagagaaaagcucagacgacaagaaacuagaagaacaacaagccaugaccgaacaacuagccaaagaaaaaggaaucucaacauucaucgaaguccucacggcguucaacacaaacggacugauaggauaccgcaacagugagagcgucaaaagcaaagguguaccggucccaacccgggacaucauauccaacgagauagacguacuguuacaaacccaaaagcaauuuuaccaagagauacugagugacgaguacugcgaucgaauaguauccgcaauccuauucgaaaacgagaaaaucgucccugaagcaggaugcugccccuacuucccggacgaaaagaaacucccccgcugucauuuccugaacgaagaacgcaggcucugggaagccaucaacaacgcgcggauuaaaaugccaaugcaagaaggagcagcaaaacgauaccagagcgcgagcuucuccgacgaacaacgccacauccuauuccacaucgcacguagcgggacagacauaacgccgaagcuaguacagaaagaauuucccgcacuaaaaacauccauaaucguauugcaaggcaaagaaaaagccauccagaaaaucgcaggguuccgauuccgacggcuagaagaaaagagcuucuggaaaagacuaagcgaggaacaaaaagacgacuucuucucagcguggaccaacacgcccgaugacaaacgccucuccaaauaccuaaugaaacaucuccuccuaacagagaacgaaguggucgaugcccuaaaaacaguuucacuaaucggagacuacggacccaucggcaagaccgcaacgcaacugcuaaugaaacaucuagaagacgggcuaaccuacacugaagcccuggaacgagguauggaaaccggagaguuccaagaacugucagucugggaacagcaaucccuucugccauacuauggacagauacucacaggcucaacucaggcccuaauggggaaguacuggcacagcgccuucaaagaaaagcgggauagcgagggcuucuuuaaaccaaacaccaacagcgaugaagaaaaauacggcagaaucgccaacccgguagugcaccagacgcuaaacgaacuccggaaacugaugaacgaacugauaacaauccucggagcgaaaccacaagaaauaaccgucgaacucgcccgagaacuaaaaguuggcgccgagaaacgcgaagacaucauaaaacaacaaacgaaacaggaaaaagaggcgguacuggccuauagcaaguacugugaaccaaacaaccuggacaaaagauacaucgagagauucaggcuccucgaagaccaagcauucguaugucccuauugccuagaacacaucuccguugcagacauagcagccggccgggcagacguggaucauauauucccccgcgacgacaccgcugacaacucauacgggaacaaggugguugcacaccgacaaugcaaugacauaaaaggaaagcgcacgccguacgccgccuucuccaauacaucggccuggggcccaaucaugcacuaccuggacgaaaccccgggaauguggaggaaaaggcgcaaauucgagacgaacgaagaggaauaugcaaaauaccuccaaucuaaaggauucgugucucgcuucgaaagcgacaacuccuacauagcaaaggccgcgaaggaauaccucaggugccuauucaacccaaauaacgucaccgcagucggaucgcucaaagguauggaaaccucaauacuacggaaagccuggaaccuucagggaaucgacgaucugcucggcucccgacacuggagcaaagacgccgacacaucaccaacaaugcguaaaaaccgcgaugacaaccgacaccacggacucgacgcuauaguagcacuauacugcagccggucccuaguccaaaugaucaacacaaugagcgagcaggguaaacgcgcaguagaaauagaagccaugaucccaaucccaggauacgccagugaacccaaccuauccuucgaagcacaaagagaacuuuuccgaaagaaaauccuugaguucauggaccuacacgcauucgugagcaugaaaacggacaacgacgcgaacggggcacuacucaaagacacaguauacuccauccuuggugcagacacccagggagaagaccuggucuucgucgugaaaaagaaaaucaaagacauaggagucaaaauaggcgacuacgaggaaguggccagcgcaauccggggccgaaucaccgacaaacaacccaaaugguaccccauggaaaugaaggacaaaaucgaacagcuacaaucgaaaaacgaagccgcucuccaaaaauacaaagaaucgcucguccaagccgcggcaguacucgaagagagcaaccgcaaacucauagaaucggggaaaaagccgauacaacucagcgagaaaacaaucagcaagaaagcgcucgagcuagucggcgguuacuauuaccuaauaucaaacaacaagcguacuaaaacauuuguggucaaggaacccucgaacgaggugaaaggauucgcauucgacacaggaucgaaccuaugccuggacuucuaccacgacgcacagggaaagcucugcggagaaaucauccgaaaaauacaagcuaugaaucccagcuacaaacccgcauacaugaagcagggcuauucgcuguacguccgucuauaccaaggcgacgucugcgagcucagagccucggaccugaccgaagcagaaagcaaccucgccaaaacaacgcacguccgccuaccaaacgcaaaaccgggacggaccuucguuauaauaaucacguucacagaaaugggcuccggauaccagauuuacuucagcaacuuggcgaaauccaagaaaggacaagacaccagcuucacacuaacaacaaucaagaacuacgaugucagaaaaguucaacucagcagcgcaggacucguccgauacgucucaccacuccucgucgacaaaaucgaaaaggaugaaguugcacucuguggggaauga

SEQ ID NO: 7514 - RNA, 3567 nt, Artificial Sequence
  Cas9 variant
augaaguacauacugggccucgacaucggggugagcuccgucggcaucgccgugaucagcgaagagaaccagaagaagaccaucgagaaccuggccgugcgcaucguucccgaggacccggacuuccacgggaaauucuacuccggcaacaccgcgucaaagaaccuggagcggacggccaagcgcgggaaucggaagaauaaccagcgcuucaaggcccggcgcgacaagcucuaccagucccugaaggagaacaacauguuccccaccagcaaccuguucgaccucuccgccguggagcuguacggccugagagccaaggcggugagcgagcaggucucccuccaagagcugggcaggauccugauccuccugaaccagcggcgcggguuccugagcaaccggaaguccgugagcgaggagaacuccaccgaguacaaggagcgcaucgccggccucgagaaggcccuggggaacaagaccaucggccagaagcuguacagcgagcuccaggagaacaacaacguuuucgagguccugcugcgggagcgcacguaccagcgguccagcuacaccgaggaguucgaccgcaucugggacgagcagaagaaguacuaccucauccugaccggguccagcaacgaggaugacaacaagggcacccuguacgaccucauccgaaaccgcaucaucuacuaccagcggccccugaagucccagaagggccugaucagcgagugccucuucgagaagcaccacaaggccguggccaagagcucccccuacuucgagcuguucagaaucuggcagaagaucaacgaccugucguggaagacgccgaacggggagcuguucaagcccaccgacgagcagaagcagaagcugaaaaacgcgcuguggaacggcgacaaccucaauccgaagcacaagcugaccguguccaagaucaaggagauccugggguacaccagccgggagaagaucuaccucaacuuuacggagcuggauggcucccgcaccuacagcauccugcgcaacgcccucaucgaagccggcaucgagaagcccgagcaguaccuguucuucaacauggagaccaacgacgagaagggcgggcuguucgagcucuggcacaucaccuacucccugccgaucgagaaggaggucaucaacgcccugaagaaccgguucggguucgacaagaaacaggcggagaucaucgcccggcgggugggcuacagcuccgacuacgggagccucuccacgcgcgccauccggaagcugcuggugcaccucgagaagggccugggcuacaccgacgccugcgacaacaucggguacgaccacagcggcuacaagaccaagaucgaccugcagcccaaguuaaagcagcucaagcgcaacgagcugcgaaaccccgucguggagcagauccugaaccagguggucaacgccgugaaccucaucaucgagaaguacgggaagauagacgaaauccgcguggagcuggcgcgggagcugcgcaauaacgccaagacccggaaaaacaucucccuccugaacagcaagaacaagaagaacaacgacaucauccgcaagaagcugcaggaggaauacggcuucaaguucgucaacgggcgggacgugacgcgcuacauccucugggaggagaacuccaaggagugccuguacugcaacaagaccaucaacggcagcgacauguugaccggcaacgccgacaucgagcacauccuccccaagucccggagcuucaacaacgccaugaacaacuacaucaucacucaccgcaagugcaacuccgacaaggggcagaagacggccuacgacuucaugagcagcaagggcgaggugauccugcagcaguacaucgagaaggucaacgaccuguacaaggacgggaagggcuccaucagcaagaccaaguucgagaaucuccugugcaagggggaggacaucccguccgacuucguggagcggaugaagaaggacagccaguacaucgcgaaggaggccgucaagauguuaaagacugugugccccaacguguacaccacgaccggccaggucaccgacuuccuccgugaggaguggaagcugaagaaccugcuccaggagcugaccuucgagaaguacaaggccaucggccaggugaaggagaagaucauaaagacgaauaacggccagaccaagacauucaaggugaucgccgacugguccaagcgggacgaccaccgccaccacgccaucgacgcgcugaucugcgcccucaccgaccaaaagaucaucuucaagcugaacaaccugaacaagaucuaccaguacgagcgcaacgcccucagccagaaggagauugaggagauugaggaguuccuggagggcaaguucuccauuaaggaguucagcgcccagcaggggaacaucaucgagugcuccauccccaacauccggaaggaugcgcagaagcaccuggagaacauccucaucagcuucaagaaggagaacuccaaaguccugacgaugaaccgcaaccagcccaagaacugcaaggagcagaucaccugggugccgcgggcccgccuacacgaggacaccaucaugggccggguuaagcgcauccccgagaagaaaaugaagcucaacgacaaggucagcuucgagcagaucaagaugaucgugaaccccgagaucaaggagauccuguuauaccggcucgccaaauucggcgacaaccccaagguggccuucgccaccaaggcgcugaagaaggagccgaucuucuaccgcgagaaugagcugaaggaagucuccaucuacgaaugggugaacaccaaacggguggcccucaaugagaacaucacggacagccagaucgagaagaucaucgaccaggccuccaagcgcgccgucaaagagagacugaacgggggcaagaucaaggagguguucaagaaccugaccgagaaccccauccagcucaagaacgggaugauccugaagaacgugaccgucaccgacgagucgaagguggagaagauccgcaacggcuucgccaucacggggaagaaccaccacgcgcugguguacaaggacgaaaacggcaaguacaacgacaaggucguguccuuuugggaggcgguggccaucggccuccguaacgucaccgaguacgggaaucccuaccccaucaucaaccgcaaccauaacgacgagcugggcgaguucuacuucagcaugcagaucaacgaccuguucguguucgaccucaagcacagcgagaacccgcaggaggagaacgagaucaacuucuucgacguugagaaccggaagcagaucuccgacaagcuguuccgcguccagaagaugagcaagaaguccaacgggcaguucgugagcgacuuccggcaccaccuggagaccucggugauccgcaacgacaugauccucaagaacaucaccuggauaagcaucuccaagaacagcgaccuggagcggcugacgaagauccgcgucaaccaccuaggagagaucaucaaggugggggaguga

SEQ ID NO: 7515 - RNA, 3585 nt, Artificial Sequence; identical to SEQ ID NO: 1715
  Cas9 variant

SEQ ID NO: 7516 - RNA, 3588 nt, Artificial Sequence
  Cas9 variant
augcaaaagaauaucaauacgaagcagaaccacaucuauaucaagcaggcacaaaagaucaaggaaaagcugggcgacaagcccuaccgcaucgggcucgaccugggcgugggguccaucggcuucgcaaucguaaguauggaagagaacgacgguaacgugcugcuaccuaaagagaucauaauggugggcagccggaucuuuaaggccagugcuggcgcugccgaccgcaagcugagccgggggcagcgcaacaaccaccgccacacccgcgagagaaugcgcuaccucuggaagguccucgccgagcagaagcuagcgcugcccgugccggccgacuuggaccggaaggaaaauucaucggagggcgagacguccgccaaacgcuuccugggggacgugcugcagaaggauaucuaugagcuccgggucaagagccuggaugagcgccugucccuccaggagcugggcuacgugcucuaccauaucgccgggcaccggggcagcagcgcgauccgcaccuucgaaaacgacagcgaggaggcccaaaaggagaacaccgagaacaagaagaucgcaggcaacaucaagcggcuaauggccaagaaaaacuaccgcacauacggggaguaucuguacaaggaguucuucgagaacaaggaaaaacacaagcgggagaagaucucgaaugccgcgaacaaccauaaguucagccccacgcgagacuuagugaucaaggaggcagaggcuauccucaagaaacaagcgggcaaagacggguuccacaaggagcucacggaagaguacaucgagaaacuuacuaaggccauaggguacgaguccgagaagcuaaucccggagagcggcuuuugccccuacuuaaaggacgaaaagcggcugcccgcgucucacaaguugaacgaggagagacgguuaugggagacccuaaacaacgcacgcuacagcgacccgaucgucgacaucgugacgggggagaucacuggcuacuacgagaagcaguucaccaaggagcagaagcaaaaacucuucgacuaccuguuaacuggguccgagcucacgccugcccagaccaaaaaguuguuggguuugaagaacaccaacuucgaagacaucaucuugcaaggucgugacaagaaggcucaaaagaucaagggcuacaagcugaucaaacucgaauccaugcccuuuugggcucggcuauccgaagcgcagcaggauuccuucuuguacgacuggaacucuugccccgacgagaagcuccucaccgagaagcuguccaacgaauaccaccucacggaggaggagaucgacaaugcuuucaacgagauagugcuauccucuagcuacgcuccccugggcaaguccgcaauguugauuauccuggagaagaucaagaaugaccugagcuauaccgaggccguugaggaggcccugaaagaggggaagcucaccaaggaaaagcaggccauuaaagaccgccugccauacuacggggccgugcugcaggaguccacccaaaagauuauagccaagggguucagcccacaguucaaggacaagggcuacaagacgccccauacgaacaaguacgagcucgaguacgggagaaucgcgaaccccguaguccaucagacacugaacgaacugcgcaagcuggugaacgaaauaauugacauccugggcaagaagccgugcgagaucggccucgagaccgcccgggaacucaagaaguccgccgaagaccgcaguaagcugucacgggagcaaaaugacaacgagagcaaccgcaaccggauuuaugagaucuauaucagaccccagcagcaagugauaauaacgcggcgcgagaacccucggaacuacauccuaaaguuugagcuucuggaggagcagaaaucccagugccccuuuugcgggggccaaaucagcccgaaugacaucaucaacaaccaggccgauauugagcaccuguuucccauagccgaguccgaggacaacgggcggaacaacuuggugaucucccacuccgcgugcaacgcggacaaggccaagaggagccccugggccgcauucgcgagcgccgcuaaggacucuaaguacgacuacaacaggauuuuaucaaacgugaaggagaacaucccccacaaggccuggagguucaaccagggcgccuucgagaaguucaucgagaacaaaccgauggcggcccgcuucaagacagacaacuccuacaucucuaagguggcccacaaguaccuggccugccucuucgagaagcccaacaucaucugcgucaaagggucucucaccgcgcagcugcguauggccuggggccuccaaggccugaugaucccguucgcuaaacagcugaucaccgagaaggagagcgaguccuuuaacaaggacgucaauagcaacaagaagauaagacucgacaaccgccaccaugcccuggacgccaucgugaucgcauacgcuucccggggguauggcaaccugcucaacaaaauggcugggaaagacuacaaaauaaacuacagcgagcgcaacuggcuauccaaaaucuuacugcccccaaacaacaucgucugggagaauauugacgcagaccuugaguccuucgaguccagcgugaagacagcucugaaaaacgcguucaucucggucaagcacgaccacucugacaauggagaguuagucaaaggcacuauguacaagaucuuuuauuccgaacggggguauacccugaccaccuacaagaaguugagcgcccucaagcugacugacccccagaagaagaagacccccaaggacuuccucgagaccgcccuccugaaguucaagggacgcgaaagcgaaaugaagaacgagaaaaucaagagcgccauagaaaacaacaagagacuguucgaugucauccaggacaaccucgagaaagcaaagaagcugcuggaggaggagaaugagaagucaaaggcggaggggaagaaggagaagaacaucaacgacgcuagcaucuaccaaaaggccauuagccucucaggcgacaaguacguucagcuuucgaagaaggagccggggaaguucuucgcaaucagcaagccaacgccaaccaccaccggcuacggguacgauaccggggacagccugugcguggaccucuacuacgacaacaagggcaaacuauguggggaaaucauccgcaaaaucgacgcccaacagaagaauccccugaaguacaaggaacagggcuucaccuuguucgagcgaaucuacgggggcgacauccuggaaguagacuucgacauccacuccgacaagaacagcuuccgcaacaauacgggcuccgccccugagaaccggguguucauuaagguggggaccuucacugagaucacgaacaauaacauccagauaugguuuggcaacaucaucaaaagcaccggaggccaagacgacuccuucaccaucaacagcaugcagcaguacaauccccgcaagcugauucucuccagcugcggauucauaaaguaccguucccccaucuugaagaauaaggaaggcuga

SEQ ID NO: 7517 - RNA, 3594 nt, Artificial Sequence
  Cas9 variant
augagcaagcauguccucggcuuagaccugggggucggaagcaucgguuggugccuaauagcccuagacgaacaagaccaaccagcugagauuuuggggaugggaucaaggaucgugccguuaaccaccgacgaccucaacgaguucucacaagguaaagcgaucucgaaaaaccaaaaacggacgacccaacgcacuauaagaaaaggguuggacagauaccaacugagacgaaaaguccucagcgaaaaacuugcgggccacgggaugcucccagacaaggacuuaaugcaacugccgguccucgaucuaugggaacucagagcacgagccgccucgccgggagaaaaauugagccuacccgaaaucggccgcguccucuaucauauuaaccagaagcguggcuacaaacacgccaaaucggacgaagcagaagaagucaccaagagaggcaaagaacaaggguacgucgccaccguaaaaggccgauacgcggaacuccaacgcgaaggagcgaccguaggacaacacuucgccugcaaacuuaaagaacaccgccaagaaucccccagcgggggcuucuucuacaacuacaggaucaaagaccaaguauacccccgcgaagcauauauagaagaguucgaccgaauaauggaaguccaaagcguauuuuacccagagguacucacucccgcauucauccaagagcuacgggacaaagugauauucuuccaacgcccccuaaaauccugcaaaggccugguaucauucugcgaguucgaaaagcaagaacggguagugcagcugaaaagggucaaccgcgagggaaaagaagaacuccaagaacgcaaaauaaccaucggccccaagguagcaccuaagucgagccccauugcucagcucugcaaauugugggagucaauccacaacauacgcauauacuacccggacggaaaggaacggcccaucacacucgaagagaaaagaaaacuacucgcauaccuacaaacgcacgacaaacugaccuuuaccgcacucaagaaagagcuaaaaaucucagacaaggagcggcucuggugcgacaagcuccucaaaggcggcauaaaaggggacacaaccaggguacugcucagaaaagcccuagccgguuacaaaagauacgaaccgcuucugagaauggaccucgaacuccgcgacuuccaagaaaucgucagcggcaaacgucucaucagacccauagucgacgaauccuacuuaucccaaccacucuauagacuuuggcacauucuauacuccaucgaggagcgggaggcaaugcggcgagcacuaauagaccaacugggcuuccucgaagaggaccuggacggcggacuccuggacaagcuguaccaaauagacuucgccaaacagggauacagcaacaaaucugccaaauucauaugcaaacugcucccacaucuccaagggggucauggauauucacaggcaugcgaacucgcaggcaagcgccacagcgcggggagccugacaaaagaagaacuggaagaaaggccccuacuagaacacauaccucuacuccaaugcaacgaacuacgccaacccaucguugagaaaauacucaaccaaaugaucaaucuagucaacgcacuccgacaaaaauacggcucaauagaugaagugcgggucgaacuagccagggaacuuaaaaugucacgcgaagaaagagaagaaaccucaaaaaggauccgaucccgcgagaaggaaaacaaggagaucgcagaacgaauaaaggaauacgaacuauacccaaccaaauccagaauccaaaaauaccgccucuggcaagaagcaggggaacaaugucuguacugcggcaggaguauagacgugguccaguuccuccgcggcgacgguguagaaauugaacacauuauccccaaguccauccuauacgacgacagcagcgccaacaaaacaugcgccugcagccgcuguaacaaagacaaagggaauagaacagccuacgaguauauccuagcagaaggacgagaggccgaauaccuagaccgccucgaaacacucuuccacgacgggaaacucaguuacuccaaacgccggcgccuucaauggaagaaagccgacaucccagucgacuucauugaacgucaacuacgacucacucaauacaucgcccgccaagcgcaagaaauucuacgccaggggauccgccgcguaggcgccuccgaaggcagcguaacggcaaaacugcgacaccuguggggauacgacgacauucugagagagcuuaauuucgagcgcuaccaaucaaugggcgagaccgagauagucagccaagaagaaaaagacggcagcauaaccaaaagcgaaagaaucaaagacuggucaaagagaaaagaccacaggcaccaugcgauugaugcucuggucgucgccugcacacgccaaggcuacauacaacgccuaaacucccuaaacuccgaagaggacagccuacaaaugcaagaagacucaaaacaaaugcgagaaaagaugggaggucagaaacggccuacagccgacaagcacuccauccuggaaaauuggcugauccuacaaccgcacuucucccaccaggaggucaaauccaaaguggcugaaauccuagucuccuucaggccgggaaaacgcacaguaucaacagguagaaacacauaccugcgcucaggcaagaaaguuacacaaagcggcgugcucauaccacgaggaccacuauccgaggaaagccucuacggacaaauacuaagaaacggggaaccgacauacgucaagaaagucgcgcucgaaagccucagcgaggcacaaaucgaacagaucguggacccaaaacucagacgcgaaauggucgcccgcacccaaccaucagaaggagcgaaacucaacccaaaacuacugcuagccacaccauucuacucugacgcagcagggacgcaaagaguccgcucaguacgcguagcaauagaaaacgggaaaaacucaaucguaccccuacgcuacaaugaauccggaaaagcaauaaccuucgucaacccgggaaauaaccaccacgucgggauauaccggacaucagaggguaaacuggucgaaagcugcguaacauucuggcaagcgguagaccgcguccgcuacggcauccccacaaucauccggaaaccaagagaaguccuggaccagcuacuccuucgcgaugacaucccggaagcccuccuagcgcaccuaccagcgagcgacugggaguucgucgaauaucuacaagccaacgaaauguuccucaucggccucaccgacgaagaaauacaaacugcacuagcggaaagcgaccuguuaacccuaucgaaccaccucuaccgcguacagaaaaugaguagcgaauacuacgucuuccgguaccaccuagagaccgaagucgcagacaacaaaaacaacacaggaaucaucccaaaauuuuaccgacuacgggggcccaacgacaccuaccugaaagccaacccacgcaaagucaaggugaaccucuuaggagaaaucuccuugccauga

SEQ ID NO: 7518 - RNA, 3615 nt, Artificial Sequence; identical to SEQ ID NO: 1718
  Cas9 variant

SEQ ID NO: 7519 - RNA, 3630 nt, Artificial Sequence; identical to SEQ ID NO: 1719
  Cas9 variant

SEQ ID NO: 7520 - RNA, 3633 nt, Artificial Sequence
  Cas9 variant
augcgcaccauccugggccucgaccuggggaccaacagcaucggcugggccgugaucaacuccgucaucaaggagcagacggagcggaucuggaucgagauggccggaagccgcaucauccccauggacgcggccauccugggggacuucgacaaggggaacuccaucagccagaccgccgagcggacccgcuuccggggcguucgccggcuccgcgagcggcagcugcugcgccgggagcgccuccacaaggugcugaagauccugggcuuccucccggagcacuaccugaaggggaucgacuucgagaagcacaccggcaaguuccuguccgggagcgaacccaagcuccccugggucaaagaccgguggggcaaguacuccuuccuguuccagacggccuucaacgagaugcuggccgauuucgcgaagcaccagcccagccucguguucgacgggaagaagaucccguacgacuggaccguguacuaccugcgaaagaaggcccugaccgagaugaucuccaaggaggagcucgccuggauccugcugaacuucaaccagaagcggggcuacuaccaguuacgcggggaagaggaggaggauaacgccggcaagagcgucgaguucuacgcgcugaaagugcuguccguggaggccaccgacgagaagaaggggcgggacaucugguacaacguccaccucgagaauggguggguguaccgccggagcuccaacgugccccuggacugggagggccgcgucaaggaguucaucgugacgaccgaccugaaccccgacggcacccccaagcucgacaaguacggggaggugaagcggagcuuccgcgccccgaaggaagacgacuggaugcugaucaagaagcgcaccgaggcggacaucacgggcacccacaagaccaucggguccuacaucuacgacgcccugcuccaggagccucagcagaagaucaucggaaagcuggucaagaccguggagcggaaguucuacaaggaggagcugaacuucauccuccagaagcagugcgcguuccacgccgagcugcaggaccgcgaccuguacaugcggugcaucgaggcccucuaccccgggaacgaggugcagcggaggaacaucgccaaccgcgacuucaucuaccugcugaucgacgacguccucuucuaccagcggccccugaagacgaagaagucccugaucgccaacugcccguacgaggagaacgaguacgugaaccgcaagaccggcgagaucaagaccgcgccccucaagugcaucgccaagagccacccccuguuccaggaguuccggcugugguacuuccucagcaacauucgcguguaucagaaggagcgggaggucaacggcacacugcaccuggacguggacgugacgaccgaguuccucaagaccgaggacgacuacgucgcccuguucgacuggcugaacucccgcaaggagauugaccagaaggccuuccugcgguaccccgccuucgggcucaaaaaggagaucaacaacuaccgcuggaacuacguggaggacaaguucuacccgugcaacgagacccgccacgcgauccugagccgccuggagaaggccggcaucgggaucgacuuccucagcgacgagaaggagacggcccuguggcacauccuguacucugucagcgacaagcaggagaucgagaaggcccucgccaccuucgcgguaaagaacgggcugaacgaguccuucguggaggucuucaagaaguucccgcccuucaagagcgaguacggggccuacucagccaaggccaucaagaaacugcuuccccugaugcggugcggcaaguacugggacaugucgcugaucgacgguaccaccaaggagcgcaucgagcggaucaucgcgggggagugcgacgaguccaucggcgccaagguuagggagaaggcgaugaaccucagcgacaucucaugcuucaagcgccugccccuguggcucgccugcuacguggucuacaaccggcacagcgaggacaaagagaucacgaagugggagacccccgccgacaucgacgcguaccuggccgcguucaagcagcacucccugcgcaaccccaucguggaacaggugaucaccgagacccuccggguggugcgcgacaucuggaagcaggucgggaagaucgacgagauccggaucgagcucggccgcgagaugaagaaccccgccgacaagcggaagcgaaugacgacccagauccuggagaacgagaacgccaaccuccggaucaaggcgcugcuggccgaguucgugaaccccgaauacgggguggagaacgugcgccccuacagccccucccagcaggagauccuccggaucuacgaagacgccgugcugaagggcgaggagcagauacccgaggacaucgacgugauccugaagaaguucaacaccagcaagcucccgaccaaguccgaauuucugcgcuacaagcuguggcucgagcagaaguaccggagccccuacacgggcgagcugaucccccuggccaagcuguucaccgccgccuacgagaucgagcacgugaucccgcagucccgcuacuucgacgacagcuucuccaacaaggucaucugcgaaagcgccgugaauaagcucaaggacaaccaguuaggguacgaguucaucaagaaccaccacggucagaagguggaagucggguucggcaagaccguggagaucuucagcguggacuccuacgagcgguucgucaaggagcaguacgccaagagcggcaucaagaugaagaagcuccugauggacgauaucccugagcaguucaucgagcgccagcugaacgacucccgguauaucucuaagguggugaaagggcuccuguccaauaucgucagagagaagaacgauagcggcgaguacgagccagaggccguguccaagaacauccuggugugcaccgggagcgucaccgaccggcucaagaaggacuggggcaugaacgacguguggaacuccaucgugagcccccguuucgagcggcugaacgcgcugacggagacccagugcuucgggcacugggagaacaaggacggcaagaaggucuuccagaccgccgugccgcucgaguaccagaagggcuucuccaagaagcgcaucgaccaccgccaccacgccauggacgccaucgugauagccugcgcgacccggaaccacgucaauuaccugaacaacgagagcgccucccgcaacgccaagaucagccgguacgaccugcagcgccuccugugcgacaagucccgcggggacggcaacggaaauuaccgguggaucaucaagaagcccuggacgaccuucacccaggacgcccgggaggcccugagcggcaucaucgugucccucaagcagaaccugcgcaucaucaacaagaccacgaacaucuaccagcacuucgacgcgaacgggacccggguguacgagaagcagaagaucggagacagcugggccauccgcaagcccaugcacaaggacaccgucuucggcgccguaaaccugcggaaggcccuaaucccccagcacuacaaccugacccuguucaucagcuccuga

SEQ ID NO: 7521 - RNA, 3642 nt, Artificial Sequence
  Cas9 variant
auggagaaaagacugggcaucgacguaggaaccaacucgcuaggaugggcgaucguagaaguggacgacgaaggcugcacgcuauuagacagaggcgucgacauauuucaggaaggcguggcgcgcgagaaaaaccaagaaaagccagccguacaagaccggacggacgcacgcgcacuaaggcgccacuacuuucgcagaaggcuccgcaaaaucgcacuccuacgagugcucgugcgccacgacuuauguccagcccuaagcgaggaacaacucaacgcguggcaagggaaagguaucuauccacucgaugacgcguucauaagauggcagcgcacggacgacaacgccgacagaaacccauacagagaccgcuuccgcugccuaacggaagaacucgaccuagcaugccgcgaagaaagguacgugcucgggcgagcacuauaucaccugugccaacgacgaggcuuucuaagcaacaggaaagacgccggaaacgaagcagaagagggaaaagugaaacaagaaauaaagacacuaucagcagacauggccgccgcgggcugcgaguaccucggagaauauuucuaccgccuauaccagaggaaagaaaagauaagaaaacacuacaccgcacgaaacgagcacuaccuagcagaguucagagcaaucugcagaaagcaaagacucgacgaagaacuacgucaagcgcucgaaaaagcgauauuuuaccaacgcccucucaagagccagaaagggcuggucggcaagugcacguucgaaaaggauaagagccgcugccccgugagccauccacgcuucgaagaguuccgaaugcuacaguucaucaacaacgucagaguuaccggcccgggcgacgcagaacccagaccccugagccccgaagaggucgaaaucgugcgcccgcuauuccucaggaaguccaaaccacauuucgacuucgaagacaucgcaaagaaaauugcaggcaaggggaacuacgcaugcaggggagagcuacugcaggcccccuacagauucaacugcgcugggaagucaaccguuaccggaucaccggucuccgccuuauucgcuucaguauucggggacgacuggcagcgcgagaucugcucguuguacacacucggggccggcaaaaacgaggaacaaauacucaacgacgucuggcacguccuauucgcauucgaagacgaagaacggcuacaggccugguuacaggaaaaacuacaacuaagcgcagacgacgccaaaacacuagcagcauucagacugccccaaggauacgcaagccucagccuaaacguaaucaacaagauacuaccauaccucagaagaggauaccgguacgaugaagcgguauucuucgcaaaccuugguaaaguacuacccgcggaagucuacgcggacccugcgcgaagaagggaagucgaacaaggaauuuccgcacagauggaugaccucggggacggagaaaagacccggaaggaggagagaauaagagauuaccuaagacgauacuggggcgucgaagaaaagcgacuagaaaggcucuaucacccgagcaugauagaagccuacccaagcgcaucaccuaauggacaaggacugcuacagcucggaagcccacgcauaccagcagucagaaacccaauggccaugagagcucuauuccgccuacgggugcuccuaaacgaacugcuacgggaaggaaaaauagacaggggcaccaaaauaaacaucgaacuugcacgcgaacuaaacgacgccaacaagcggaaagccaucgaacgauaucaaagagaacgggaagccgaaaacaggaaauaugccgaagaaauacgacagcaguacguagaggcuacaggccacucaauagaacccagcgaggaagacauccuaaaauacagauuguggguagaacaggggcauugcagccuguacacugggaagacaaucgguauuagcgaguuccucggcgacggacgccgauacgacauagagcacacaguaccgcgcagccgcggaggcgaggacgcgcaguacaacaagacacucugcgaagaagaguucaacagagacauaaaaagagacaagcuaccauccgagcuagcgaaccacacagcaauauuagccugcgucgaaagcugcggcugguucgagcgaauagaaggacucgagcacagaguguggggagcagacagacgagcaaaaagcgccacaaccaaaagcgcgaaggacuucgcaauacaagaccgacacuacuggagaaugcaccucgacuacuggcgaagaaaaugcgaagcguucacgaugacugaaguccccgaaggauucagcaaccgacagggcguagacgucggcauaauaggacgauaugccagacuauaccuccagaccguauucgaccgggucuacacagucaaaggagcgacuaccgcagcguuccgaagaaugugggggcuacaggaggaauacgcagcuaaggaacgagucaaccauguacaccacuguauagaugcgauuacaauagcuugcauaggcucgcgagaguacgcguuaugggcccaauacgugcgccaggacgaacuguaucgcuggggcgaagccgauaagccacgaugcggaaaaccguggcccacauucaccgaagacgucagagcaacagccgacgagcuacucauuagccaccacacgccagauaauaugcccaaacaaucgcgaaagcggcuaagaguaaggggcaaagugcagcggaacgacaggggcgagguaaaauacaugcagggcgacacagcccgcggagcccuucaccaacaaacauucuacggcgcgaucgagcgcgauggggaaauaagauacguaguaaggaaaucgcuggaccaacuacuaccagcagacguugagaaaauuguagacgaggccguccgacaaaagguaagagaagccgucgaggcguauggcuucaaggaggcgacagacccgacgaaacacacaguauggaugaacgaagagaagcaaauuccaaucagaaaagugcgaauauuaacgggcgugaaaaacccgauccuacucaaaccccacagagacguauccguaaaagaauacaagcgguacuaccaugucguaaacgacggaaauuacuguauggcaauauacgaaggaagagaccgccagggccgacuaaaaagaacauucgaaaucgugaacaaacuugaagcagcaagauacuuuaaacgcucagcagaccgugagagccgaccagaccugguaccacugagcgaugugaauggcuacagccuaaaguaccucuuaaagaccgggacgaugguccucuucuacgagaacucgccggacgagcucuacgaaugcucaguaggcgaacuagcaaaacgacuguacaaggucguagggauggcgcaagaugggcgcguacaauuucuauuucaccaagaagcgagagaucagaaagcgguuacggcagaaugcggcaugggcauaucgguguucgacgcaagacacccagcaccgaaacugcguauacgcguauccaacuucaaaauguucguagagggcuaugacuucgaacuaacagugaccggagaagucaaauucaagagauga

SEQ ID NO: 7522 - RNA, 3642 nt, Artificial Sequence
  Cas9 variant
auggaaaagcgacuaggcauagacgugggcaccaacagcuuaggaugggccaucguagaaguggacgacgaggggugcacacuccuggacagaggggucgacauauuccaggaagggguagcacgcgagaaaaaccaagaaaaaccggcaguacaagaccgcaccgacgcaagagcauuaagaaggcacuacuucaggcgcagacugagaaaaaucgcacucuuacgcgugcucguccgacacgacuuaugcccagcacugagcgaggagcagcuaaaugcguggcagggaaaaggaauauacccguuagacgacgcauucauacguuggcaacggacagacgacaacgcagacagaaacccauauagggauagauucagaugccugacagaggaacuagaccuggccugucgcgaggaacgauacgugcucgggcgagcgcuauaccaccuuugccaacgcaggggauuucucucgaacaggaaagaugcaggaaacgaggcagaggaaggcaaggucaaacaagaaaucaaaacacucagcgcagauauggcggccgccgggugcgaguaucugggagaguacuucuacagacuguaccagcgcaaggaaaagauacggaagcauuauacggcaaggaaugaacacuaccuagccgaguucagggcgauaugccgcaaacaaagacuugacgaagaacuacgacaggcgcucgaaaaagcgauauuuuaccagcgaccccugaaaagccagaaaggauuaguaggcaaaugcacauucgaaaaagacaaaagcagauguccaguaagucacccgagauuugaagaguuccgaaugcuccaauuuauaaacaacguccgugugacgggaccgggcgacgcggaaccgagaccccugucaccagaagaaguagaaauaguccgaccacuguuucugagaaaaucaaaacuacacuucgacuucgaagacaucgcaaagaaaauagcgggcaaaggaaacuaugcaugcagaggagagcuccuccaagcacccuaccgauucaacugcgccggaaaaucgacugugaccggcucccccguaucagcacuguuugcgucaguguucggagacgacuggcaacgagaaauaugcagccuguacacgcucggcgccggaaagaacgaggaacaaauccugaacgacguguggcacguacuguucgcguuugaggacgaggaacggcuccaaacauggcuccaagaaaaacugcagcucucugcagaugacgcgaagacacuagcggcguuccgccugccacagggguacgcaagucucagccugaacgucaucaacaaaauacuccccuaccuuaggagaggauacagguacgacgaagcugucuuuuucgcaaaccuggggaaaguccuucccgcagagguauacgcggacccagcaaggagaagagagguagaacaaggaauuagcgcgcaaauggacgaccucggggacggcgaacaaacgcggaaagaagaaaggauacgagacuaucuccgacgauauugggguguggaagaaaagagauuagaaagacucuaucacccauccaugauugaggccuacccauccgcgagccccaacggccagggacuccuacaacuagggucaccgcgcaucccagcgguacgaaacccaauggccaugagggcgcuuuucaggcuaagagugcuccuuaacgaacuccugagagaaggaaaaauagacaggggaacaaaaauaaacauugaacuggccagggaacuaaacgacgcaaacaaacgaaaagcaaucgaacgauaccaaagggaaagagaagcagagaacagaaaguaugccgaagaaauacggcagcaguacguagaggcgacagggcacucgauagaaccaagugaggaagacauccugaaauacagacuguggguagaacaaggacacugcucauuguauacagguaaaacaauaggaaucuccgaguuccuaggggacgguagacgcuacgacauagaacauaccgugccaaggucacgaggcggagaagaugcacaauacaacaaaacacuuugcgaagaagaguucaauagggacaucaaaagggacaaacuaccaagcgaauuggcaaaccauacagcgaucuuagcauguguagagagcugcggcugguuugaaaggauagagggacuugaacaccgggucuggggcgcggacaggcgcgccaagucagcgacaacgaaauccgcgaaggacuucgcaauacaagacaggcacuacuggaggaugcaccuagacuacuggagaagaaagugcgaagccuucacgaugacggaaguaccagaaggcuucagcaaccggcaaggcgucgacgucggaauaauaggcagauaugcacgacucuaccugcagacggucuucgacaggguguacacagucaaaggagccacgacagcggcauucaggcggauguggggacuccaagaagaauacgcagcaaaagagagaguaaaccacgugcaucacugcauagacgcgauuacaaucgcaugcaucggaucacgagaguacgcgcugugggcacaguacguccgacaggaugagcuauacagacggggcgaggccgacaaacccaggugugggaaacccuggccaacguuuacagaagacgucagggccaccgccgacgagcuguuaauaagccaccacacacccgacaacaugcccaaacaaagucggaagagacuacgcguaagagggaagguccaaagaaacgaccgcggcgaaguaaaauacaugcaaggagacacugccagaggagcccuucaccaacaaaccuucuacggcgcgaucgagagagauggagaaauccgguacguuguuaggaaaucucuagaccaacugcuccccgcggacgucgagaaaauaguggacgaagcgguccgccaaaaaguccgggaggccguagaagcauauggauuuaaagaggcgacggaccccacaaagcauacggucuggaugaacgaagaaaaacagaucccuauccgaaaaguucgaauacucacaggggucaaaaaccccauacuucuaaaaccgcacagggacguaagcgucaaagaguacaaacgauacuaccacguagugaacgacggcaacuacugcauggcgauuuacgaagggagggaccggcaaggccggcugaaacgaacguucgaaauagugaauaaacuggaggcagcaagauacuucaagcgaucagcggacagagagagucggcccgaccucgucccauuaagcgacguaaacggauacaguuuaaaauaccuucuuaaaacgggcaccaugguccuauucuacgaaaacucgccagaugaacucuaugaaugcucggucggagaacuagccaaacggcucuacaaagugguuggcauggcacaagacgggagggugcaguuccuguuucaccaggaggcacgagaccagaaagccguaacggcagaaugcggaaugggcauuagcguguucgacgcacggcacccagcacccaaacugcgaauacgaguaagcaacuucaaaauguucguagagggcuacgacuucgaacucaccguaacaggugaagugaaauuuaagcgauga

SEQ ID NO: 7523 - RNA, 3651 nt, Artificial Sequence
  Cas9 variant
augaccaagaucuugggcaucgacaccggaacgaacagccucggcugggccaucguggacaagaccgccgacaauuacaaccugcuggacaaggggguuaauaucuuccaggagggcgugaagaucgagaaggggaucgagucaagcaaggcggccgagcgcaccgagcaccgggccacccgcgugagauacuaccgcaucaagcugcggaagauccgccugcugcggauccucuccgacaaccaccugugcccgccacugagccaggaggaacuaucuacguggcgccugaaaaaggucuaccccaagaacgagcuguucaugcaauggcagcggaccgacgacgacaccgagaagacgcccuaugcuuaccgccacaagugcauacacgagaaacucgaccugagugaugugacggaccgguacauccuggggcgcgcguucuaccacaucauccagcgacgcggcuuccucucaaaccggaaggagcaagguggggaggauagcgggaaggugaaggaaggaaucuccacccuuacccaugagaugaacgaggcgggguacgaguaccugggcgacuacuucuacgcacucuacaacaagggcgaaaagauccgcaagcacuacaccgcccggaacgagcacuuccugagcgaguucaaggccauaugcgagaaacaggaucuggagaaggagcucggauccgaggucgugcgcaacaucgagaaggccaucuuugaccaacggccacucaagucccaaaaaggacaggucgggaagugugucuucgagaaaaacaagacaaagugcccguccagccaucccauguacgaggaguuccgcaugcugaccuuuaucaacaacauuaaaaucaagacacccaacgacgacgugcuccggccccugaacacuggggagcgggagaagaucaugccgcuguucuuccgaaaguccaaaaagcaguucgacuucgaggacaucacgaagaagcucgcacccaagaaaauguacggcuucuacaagaaagaggaggaugccgagaugcccuucuuguuuaacuauccgauggacaccagcguguccgggugcccgguuaccgccgcccugaaggacguuuucggcgacgacuggaucacggcgaucugcgagacguacacccucggggagggcaagagcagauucgauaucgugaacgacaucuggcacgcccuguacuucuacuccgacaaggacaagcuggccgaguucgccaucaaccgccuacagcugucagaggacgaagccaagaucuucucagaaaucucccugccagcggacuacgccagcuuauccuuaaaggccaucugcaagauccugcccuaccuccggcgcgggcugaucuacagccacgcgguauuccugggcaaccucugcgaggugaugccgaaauacgaaugguccaucaaggagaugcgagagaccaucaucgacaacauuaucauggagauggacaaaugcgacaccaaggacaagcgcacguucgaggugugcaucaaggauuaccugaaggggcaguacaacgucagugauaacucccugaagaaacucuaccauccgagcaugaucgagaccuacccccggguccaauacaccaaugagcaugggguguaucagcugggcagcccccgcaucgacuccguccggaaccccauggccaugcgcaguauguuccgccugcgcaagcucgugaaccggcuucucguggagggcaagauugaucagaacaccgagguccacaucgaguucgcgcgggaguuaaacgacgcaaacaagagaaacgcgauagcuuuauucgugaaggaaaaccagagcgcuaacgaugaagcucgcaagcaaaucaucacgcuguucaagaaggaaaccggcaccgacauugaaccgaccgauaaggacauccugaaauacgugcucugggaggagcagaaccacaucugccuguacacggggaagcagauacggaucuccgacuucaucggcgccaacccaaaauuugacauagagcacaccaucccccguagcgugggcggggacucuaccaaaaugaaccugacccuuugcgacagucgguucaaccgagaagugaagaagaccaaacugcccguagagcuaccgaaucacgacgagauaauggagcgcaucaaggaguggaagaagaacuacgaguugcuggauauccagauccgcaagaacaagaagcuguccaagggugcuaccaccaaggagcagaaggacacuaucauccgcaagcggcaccuccuggaguugcgccgagacuacuggcgcgggaaguacgagcgauucaccauggagagcgugcccgagggcuucuccaggcggcagggcacggacaucucggugauuagcaaauacgcccgccucuaccugaagucccuguucaacagggucuauaccgugaagggcaucgcaaccagcgacuuccgcaagauuuggggcauccaggacaucuauuccaagaaggagcggaucaaccacgugcaccacuguaucgacgccauagucauagccugcaucggccucgacgaauacaacaagcugggugccuacuaccacgacgaggagaauaacaagugguaugguaugagcaaggccuccuucaagaagcccugggcgaccuucguggaagauaucaaaaagauccaggacgagauccugguguaucacuacacuccggacaacaugccuaagcaaggcagacgacgcauaaagaucgacgggaaaaagauccucuguaagggggacgccgcccggggcagccuccacaacgacaccuacuacggggcaauugagaaugacggcgcagucaaguacgucaagagaaucgacuuagcguccuuagaagagaaggacgucaagaacaucgucgaugacaccgugcguagcaucaucgaggccgccaucaaggagaagggcuucaaagacgcuauggcuucgaccaucuggaugaacgaggagaaacgcguucccauuaagaagguccggugcuucacgcccagcauaaccaagccucugaacauccgcaagcagcgcgacguauccauaaaagaguacaagcaacaauaccacguggcgaaugacagcaacuaucuucucgcccucuacaucggcacagacaacaagggcaaggagaagcgggaguucgagaucgucaauauccuacaggccgcccaauacuaccggaccucuaacgacaaagaaguaguggaccggcacaucguucccaucaaaagcgagcaugacuaccccuucgcguacacgcucaaaauagguaccaugguucuccuguacgagaagagucccaacgagguaugggacgccaccaucaaggagcggaaccgacgccucuauaaggucacgggccuuagcacgaugcggaugaaggggcgcaacggcgaguaugccuacgcuaccguaaaacugauccacaaugaggaagcccggccguccaaggauaucaaggcgaagaacggggaguacgagcagggcgaggaguuccgcccugccaucaucaugcuccacacucagcugaacgcccugguacaaggcuaugacuucgagauuaacgaacugggagagauccggcgcuugcgguga

SEQ ID NO: 7524 - RNA, 3654 nt, Artificial Sequence
  Cas9 variant
auggagaagcaacgcauccugggucucgaccccgggaccaacagccugggcugggccguacuagacuucgacaacuccaagcaggaguacaaccucguccggaagggggaggugauuuucgaggagggcgugggcaagagcgagcgcggggaguucuccaaggccgcguaccguaccuucuauaagagcacgcgcaagcacuacuuccggcgccggcugcgcaagauugagguccugaaggugcucgugaaguacgacuucugcccguaccuguccgacgaccugcucaagcaguggcacgagaagaagaucuaccccgccgucaaggaguucauggacuggcagcggaccagcgacgccgagggcaagaaccccuacuacgaccgccauugcugccugaacgagaagcuggaccucucccucaagagcgaccgguacauacuggggcgcgcccuguaccaccugacccagcggcgcggcuucaaguccaaccggcugauccagaacaacgacgagaacgaggaggggaaggucaagaagggcauaagcgagcucuccaccgagaugcaggaggccaacugcaacuaccugggggacuacuucuacaagcuguacacggagaaaggcaacaccgugcagauccgcaagcgguacaccgaccgcgagaagcacuacaagaacgaguucaacgcgaucugcgagaagcaggagcucaacgagaccaucgucaaggagcuggacaaggccauuuucuuccagagaaaacugaagccccagcgccacggcguggggaaaugcacguucgagccgaacaaccggcgcugcgccaucagccaucccgacuucgagcgcuuccggaugcucugcuucaucaauaacaucaagaucaagacacccuucgaggagaaccugcgcccccugaacaacgaggagaaggcccucaucgaaccgcuguucuacagaaaguccaucaagaacuucgacuucgaggagaucgcgaagaagcuggccggcaagaacaacuacugcuacaucaaggacgacagcuccaagcaguacaaguucaacuaccgcaugagccagggggccuccacgugccagaccaucgccaagcucaagagcaucuuuggcgaggaguggaagaacggcaucgccgagacguacaccaaccggcgcaagaaggaggggcugaagaagcaggcggagaugguggacgacaucuggaacguccuguacuccgugagcgagugcgacgugcucaaggacuucgccaucaacaagcugcagcuggacgagaagacagccgacaacuucagcaagaccaagcucgcccagggcuucgccacgcugucccugaaggcgauccggaagauccuccccuuccuggagcagggguucggcuacaccgaggccgucuuccuggccaacauucccaccgugguggggaaggaguacuggaacaacgaggacauccgcaacgacaucauggaggagaucaagaccaucuucuaccauaacacgcucaagaccaacgauagccacaacaccauccuguucugcaucaaggacauccuguccaacaacuucgaccucgcccccggcgccaucgacaagcuguaccauccgagcaugaucaacguuuacaaggacgugauccccaacgaggacggcauccuccagcucgggucccccaagaucgacgcggugaaaaaccccauggccaugcggagccugcacaucauccgaaaggucgugaacgagcugcugcgggagggcaucaucaacuccgacaccgaggugcgcauagaguacgcccgggagcucaacgacgccaacaagcgccacgccaucgcggacuggcagaagaagcaguacgggaagcaccagaaguaucggaaggagaucaaggaacuguucaaggccgagacgggcuucgagaucgagccgaacgagaccgacauccugaaguucgagcucugggaggagcagaaccacaucugccuguacaccgggcaggagaucggcaucagcgaguucgucggcgagaaucccaaguacgacaucgagcacaccuucccucgcucccucgggggcgacagcacgaagaugaacaugacccugugcgagaacaaguucaaccgggagaacaagcagaagaaacugcccuccgagcuggccaaccacagcgagauccucgagcgcauugacgacuggaagaagaagaucuacauccugcagaagaaguacgacuccauccggacccacaacgggauggacaaggagaacaaggacaagaagaucgugagccgccauaagaucaagcuggagcuggacuacuggaagggcaaguacaaccgcuucaccaugacggagaucccggagggguucucccggcgccagggcaugggcaucgggcugaucagccgguacgcgggccuguaccucaagaccaucuuccacaagaaggacaacccccagaaguccaacgucuacaucgugaaggggagcaucaccgcggaguuccgccggaucuggaacauccaggaugacuacgagaagaaaugccgcgacaaccacauccaccacugcaucgacgccauuguggucgggugcauaggcaagcgggaguacgaccugauggcccaguucuaccgagacgaggagaaguaucggugggagaagaagaagaagcccuucuucaagaagcccugggagaccuucacgcaggacaugcugagccucaaggacgaggugcugaccgugcacuucaacccguccaacuucacuaagaaggcccauaagaaggucuucacccccaaggggaucuucgucgcucagggcgacugcgcgcgcgugaagcugcacaaggggagcuacuucggcgccaucgaacagaagggggagaucaaguacgucaugcggaaggagcucuccgcccugaagaucgaggacaucaagaacaucguggacgccguggucaaggaaaaggugcuggccguggucaagaagaagggcuucaagcaggcgauggccgaacccaucuacaugaaugaggacaagagaauccucaucaagaaggugcggcuguucgugagccaggccaauccacugaucgucaagaagcaccgcgaccucuccucuaaggaguacaagcagaacuacuacguggauaacgagggcaaccugaugaucgccauguacgagggggugaagaagaacggcaagaucgaccgggagaucaccgucguuaacaaccuggaggccgcgaaguucuuccgccagucccagaagaacaacgccgagaagcaacucaucagccaccuguccccgaagaacggguacccccugaagacggugcucacacagaagcagcugguccugauguacgaggacagccccaaggagaucaagcuccgggacaccaagaacaugguaaaacgccuguaccagguguucggaaucgagaaagacgggcgggucaagcugaaguuccaucaggaggcccgcuccgagggacucaacaucaacagcgccgcguucaagauccaggacaccccggagucccuguaccggcacaccaagagcaaccugaaggugcucgugaacggugucgacuucaagaucaacauacugggggagaucucccugauuuga

SEQ ID NO: 7525 - RNA, 3654 nt, Artificial Sequence
  Cas9 variant
auggagaagcagcgcauccugggccucgaccccgggaccaacagccugggcugggccgugcuggacuucgacaacuccaagcaggaguacaaccucguccggaaaggggaggugaucuucgaggaaggcgugggcaagagcgagcgcggggaguucuccaaggcagcguaccggaccuucuacaagagcacgcgcaagcacuacuuccggcgccggcugcgcaagaucgagguccugaaggugcucgugaaguacgacuucugcccguaccuguccgacgacuuacucaagcaguggcacgagaagaagaucuaccccgccgucaaggaguucauggacuggcagcggacgagcgacgcagaaggcaagaaccccuacuacgaccgccacugcugccugaacgaaaagcuggaccucucccucaagagcgaccgguacgugcuggggcgcgcccuguaccaucugacccagcggcgcggcuucaaguccaaccggcugauccagaacaacgacgaaaacgaggaggggaaggugaagaagggcaucagcgagcucuccaccgagaugcaggaggccaacugcaacuaccugggggacuacuucuacaagcuauacacggagaaaggcaacaccguccagauccgcaagagauacaccgaccgcgagaaacacuacaagaacgaguucaacgcgaucugugagaagcaggagcucaacgagaccaucgugaaggagcuggacaaggccauuuucuuccagcggaagcugaagccccagcgccacggcgugggaaagugcacguucgagccgaacaaccggcgcugcgccaucagccaccccgauuucgagcguuuccggaugcucugcuucaucaauaacaucaagaucaagacccccuucgaggagaaccugcgcccgcugaacaacgaggagaaggcccucaucgagccgcuguuuuaccggaaguccaucaagaacuucgacuucgaggagauagcgaagaagcuggccggcaagaacaacuacugcuauauuaaggacgacuccuccaagcaguacaaguucaacuaccgcaugagccagggcgccuccacgugccagaccaucgccaagcucaagagcaucuucggcgaggaguggaagaacggcaucgccgagaccuacaccaaccggcgcaagaaggaggggcugaaaaaccaggcggagauggucgacgacaucuggaacgugcuguacuccgugagcgagugcgauguccucaaggacuucgccaucaacaagcugcagcuggacgagaagaccgccgacaacuucagcaagaccaagcuagcccagggauucgccacgcugucccugaaggcgauccggaagauccuccccuuccuggagcagggguucggcuacaccgaggccguguuccuggccaacauccccaccguggucgggaaggaguacuggaacaacgaggacauccgcaacgacaucauggaggagaucaagacuaucuucuaccacaacacgcucaagaccaacgacagccacaacaccauucuguucugcaucaaggacauccuguccaacaacuuugaccucgcccccggcgccaucgacaagcuguaccacccgagcaugauaaacguguacaaggacgugauccccaacgaggacggcauccugcagcucgggucccccaagaucgacgcggucaagaaccccauggccaugcggagccuacacauaauccgcaagguggugaacgagcugcugcgggaggguaucaucaacuccgacacugagguccgcaucgaguacgcccgggagcucaacgacgccaacaagcgccacgccaucgcggacuggcagaagaagcaguacgggaagcaccagaaguaccggaaggagaucaaggagcuguucaaggccgagacgggcuucgagaucgagccgaacgagaccgacauccugaaguucgagcucugggaggagcagaaccacaucugccuguacaccgggcaggagaucggcaucagcgaguucgugggcgagaaccccaaguacgacaucgaacacaccaucccccgcucccucgggggagacagcacgaagaugaacaugacccugugcgagaacaaguucaaccgggagaacaagcagaagaagcugcccuccgagcuggccaaccacagcgagauccucgagcgcaucgacgacuggaagaagaagaucuauauacugcagaagaaguacgacuccauccggacacacaacgggauggacaaggagaacaaggacaagaagaucgucagccgccacaagaucaagcuggagcucgacuacuggaagggcaaguacaaccgcuucaccaugaccgagaucccggagggguucucccggcgccagggcaugggcaucgggcugaucagccgguacgccggccuuuaccucaagaccaucuuccacaagaaggacaacccccagaagaguaacguguacaucgugaaggggagcaucaccgcggaguuccgccggauuuggaacauccaggacgacuacgagaagaagugccgcgacaaccacauccaccacugcaucgacgccaucgucgugggcugcaucggcaaacgggaguacgaccugauggcccaguucuaccgcgacgaggaaaaguaccggugggagaagaagaagaagcccuucuucaagaagcccugggagaccuucacgcaggacaugcugucccucaaggaugaggugcugaccguccacuucaacccgagcaauuucaccaagaaggcccacaagaagguguucaccccuaaggggaucuucguggcccagggcgacugcgcgcgcgucaagcugcacaaggggagcuacuucggcgcuaucgagcagaagggggagaucaaguacgugaugcggaagaagcucuccgccuuaaagaucgaggacaucgagcacaucguggacgccgucgugaaggagaaggugcuggccgucgugaagaagaagggcuucaaacaggcgauggccgaacccaucuacaugaacgaggacaagcgcauccucaucaagaaggugcggcuguucgucagccagaccaacccccugaucgugaagaagcaccgggaccucuccagcaaggaguauaagcagaacuacuacguggacaacgagggcaaccugaugaucgccauguacgagggggucaagaagaacggcaagaucgaccgggagauaacgguggugaauaaccuggaagccgccaaguucuuccgccagucccagaagaacaacgcggagaagcagcucaucagccaccuguccccaaagaacggguacccccugaagaccguccucacccagaagcagcuggugcugauguaugaggacagccccaaggagaucaagcuccgggacaccaagaauaugguaaagcgccuguaccaggucuucggcaucgagaaggacgggcggguggagcugaaguuccaccaggaggcccgcuccgagggcuugaacaagaacagcgccgccuucaagauacaggacacgccggagucccuguaccggcacaccaagagcaaccugaaggugcucgucaacggcguggacuucaagaucaacauccugggggagaucucccugaucuga

SEQ ID NO: 7526 - RNA, 3654 nt, Artificial Sequence; identical to SEQ ID NO: 1726
  Cas9 variant

SEQ ID NO: 7527 - RNA, 3657 nt, Artificial Sequence
  Cas9 variant
augaacaagcgcauccugggccucgauacggguaccaacagccuaggcugggccguggucgacugggacgagcacgcccaguccuacgagcugaucaaguacggggacguaaucuuccaggaaggcgugaaaaucgagaaggggaucgagagcucaaaggcggccgagcggagcggcuacaaggccauccgcaagcaguacuuccgacgccggcuccgcaagauccagguccucaaggugcuggucaaguaccaccucugcccauaccuguccgacgacgaucugcgccaguggcaccuccagaagcaguaccccaagucagacgagcugaugcuuuggcagcgcacguccgacgaggagggcaagaacccguacuacgaccggcaccgcugccuccacgagaagcuggaccuuaccgucgaggccgaccgguacacccucgggcgcgcccuguaccacuugacccaacggcgcggcuuccucuccaacaggcuggacacguccgcggacaacaaggaggacggggugguuaagucagggauuucccagcugagcaccgagauggaggaggccgggugugaauauuugggcgacuauuucuacaagcuguaccacgagcagggcaacaaggugcgcauccggcaacgcuacaccgaccggaagaagcacuaccagcacgaguucgacgccaucugcgagaagcaggagcuguccagcgagcucaucgaggaccugcagcgcgccaucuucuuccaguugccgcucaagagccagcgccacggggugggccgcugcaccuucgagcgcgggaagccccggugcgcggacagccacccggacuacgaggaguuccgcaugcugugcuucgugaacaacauccaggucaagggcccccacgacuuagaguugcggccccuaacguacgaggagcgcgagaagauagagcaccuguucuuccggaagucaaaacccaacuucgacuucgaggauaucgccaaagagcuggccgggaagaagaauuacgccuggauccacgacaaagaggagcgcgccuacaaguucaacuaccgcaugacccagggggugccgggcugccccaccaccgcgcagcucaagagcaucuucggggacgacuggaagacgggcaucgccgagaccuacacccuuauccagaagaagaacggauccaagucacugcaggagaugguggaugacgucuggaacguccuguacucauucuccucuguggagaaacuaaaggaguucgcccaccacaagcuccagcuggacgaagagaacgccgagaaguucgccaagaucaagcugucccacuccuucgcggcgcucucccugaaggccauccgcaaguuccugcccuuccugcggaagggcauguacuacacccacgccagcuucuucgccaacauccccacgaucgucggcaaggagaucuggaacaacgagcagucccgcaaguacaucauggagaacgugggggagcugguguucaacuaccagccgaagcaccgggacguucagggcaccaucgagaugcuuaucaaggacuuccucgcgaacaacuucgagcugcccgccggggccacggacaagcuguaccaccccagcaugauagagaccuacccccacgcccugcgcaacgaguucggcauccuccaacuggguuccccgcggacgaacgccauccgcaaccccauggcgaugcggagccugcacgugcuccgucggguggucaaccagcugcugaaggagucuaucaucgacgaaaacaccgaggugcacgucgaguacgcccgcgagcucaaugacgccaacaaacggcgcgccauagcggaccgccagaaagagcaggacaagcagcacaagaaauauggcgacgagauucggaagcuguacaaggaagagaccggcaaggacaucgaacccacccagacggacgugcuaaaguuccagcucugggaggagcagaaccacuacugccuguacaccggggagcagaucggcaucaccgauuucaucgggagcaaccccaaguucgacaucgagcacaccaucccgcagucggugggcggggacagcacgcagaugaaccugacccucugcgacaaccgcuuuaaccgggaggucaagaaggccaagcugcccaccgagcuggcgaaccacgaggagauccuaacccgcaucgagcccuggaagaacaaguacgagcagcuggugaaggagcgggacaagcagcgcaccuucgccggcauggacaaagccgugaaggacauccggauacagaagcgccauaagcugcagauggagauugacuauuggcggggcaaguaugagcgcuucaccaugaccgaggucccggaggguuucucccggcgccagggcaccggcaucggccucaucagucgguacgcgggccuauaccugaagucccucuuccaccaggcagacagccggaacaagaguaacgucuacguggucaagggagucgcaacggccgaguuccggaaaauguggggccugcagagcgaguacgagaaaaagugccgcgacaaccacagccaccacuguauggaugcaaucaccaucgcgugcaucgggaagcgggaguacgaccugauggccgaguauuaccacauggaggagaccuuccgccagggccgggguucaaaaccgaaguucucgaagcccugggccaccuucaccgaggacguuuuaaacauuuacaagaaccugcuggucgugcacgauacgcccaacaacaugcccaagcacaccaagaaguacguccagacuuccaagggcaagguccucgcccagggcgacaccgcccgcgggagccugcaccuggacacguacuacggcgcuaucgagcgggacggggagauccgcuacguggugcgccggccgcucuccagcuucaccaaccccaaggagcuggagaacaucguagacgagaccgugaagcgcacgaucaaggaggccaucgccgacaagaacuucaaacaggccaucgcggagcccauuuacaugaacgaggacaagggcauacugauuaagaagguacggugcuucgccaacuccgucaagcagcccaucaacauucgccagcaccgggaccucagcaagaaggaguacaagcagcaguaccacgugaugaacgagaacaacuaucugcuugccaucuacgaggggcucgugaagaacaagguggugcgcgaguucgagaucguguccuacaucgaggccgccaaguacuacaaacggagccaggaccgcaacaucuucuccagcaucguccccacgcacuccaccaaguacggccugccccugaagaccaagcuccugaugggccaacaggugcuaauguucgaggagaaccccgacgagauccagguggacaacacgaaggaccucgugaagcggcuguacaaggugguggggaucgagaaggauggccgcaucaaauucaagcaccaccaggaagcgcggaaggaggggcugacuaucuacagcaccccguauaagaacaacgacgacuacguccccaucuuccgccaguccaucaagaacaucaacauccucguggacggcauugacuucaacaucgacauccuggggaaggugacccugaaggaguga

SEQ ID NO: 7528 - RNA, 3657 nt, Artificial Sequence
  Cas9 variant
augaacaagcgcauccugggccucgacaccgggaccaacagccugggcugggccguggucgacugggacgagcacgcccaguccuacgagcugaucaaguacggggaugugaucuuccaggagggcgugaagaucgagaaggggaucgagagcuccaaggcggcugagcggagcggcuacaaggccauccgcaagcaguacuuccggcgccgacucagaaagauccagguccugaaggugcuggugaaguaccaccucugccccuaccugucagacgaugaccugcggcaguggcaccuccagaagcaguaccccaagagcgacgagcuaaugcuguggcagcgcacguccgaugaggagggcaagaaccccuacuacgaccggcacagaugccuccacgagaagcuggaccugaccgucgaggccgaccgguacacccucgggagggcccuguaccaccugacccagcggcgcggcuuucucagcaaccggcuggacacgucagcggacaacaaggaggacgggguggucaagagcggcaucucccagcuguccaccgagauggaggaggccgggugcgaguaccucggcgacuacuucuacaagcuguacgacgcccagggcaacaaggugcgcauccggcaacgcuacaccgaccggaacaagcacuaccagcacgaguucgacgccaucugcgagaagcaagagcuguccucagagcugaucgaggaccugcaacgcgcgaucuucuuccagcugccccucaagucccagcggcacgggguaggccgcugcaccuucgagcgcgggaaaccccggugcgccgacagccacccggacuacgaggaguuccgcaugcugugcuucgugaacaacauccaggucaagggcccccacgaccuggaacuccggccccugacguacgaagaacgcgagaagaucgagccccuguucuuccggaaguccaagccgaacuucgacuucgaggacaucgccaaggccuuggccggcaagaagaacuacgcguggauccacgacaaggaggagcgcgcuuauaaguuuaauuaccggaugacccagggggugcccggcugccccacuaucgcccagcucaagagcaucuucggggacgacuggaagaccggcaucgccgagacguacacacugauccagaaaaagaacggguccaagagccugcaggagaugguggacgacgucuggaacgugcuguacagcuucuccagcguggagaagcugaaggaguucgcccaccacaagcuccagcuggacgaggaguccgcggagaaguucgccaagaucaaacugucucacuccuuugccgcccucagccugaaagccauccggaaguuccuacccuuccuccggaagggcauguacuacacccacgcguccuucuucgccaacaucccgaccaucgucggcaaggagaucuggaacaaggagcagaaccgcaaguacaucauggagaacgugggggagcugguguucaacuaccagcccaagcaccgggagguccagggcacgaucgagaugcugaucaaggacuuccucgccaacaacuucgagcugcccgccggggccaccgacaagcuguaccaccccagcaugaucgagacuuacccgaacgcgcagcgcaacgaguucggcauccugcagcucggguccccgcggaccaacgccauccgcaaccccauggccaugcggagccugcacauccugcgccgcguggugaaccagcuccugaaggaguccaucaucgacgagaacacggagguccacguggaguacgcccgcgagcugaacgacgcgaacaagcggcgcgccaucgccgaccgccagaaggagcaggacaagcagcacaagaaguacggcgacgagauccggaaacucuacaaggaggaaaccggcaaggacaucgagcccacccagaccgacgugcugaaguuccagcugugggaggaacagaaccaccacugcuuguacacgggggagcagaucggcaucaccgacuucaucgggagcaacccgaaguucgacaucgagcacaccaucccccaguccgugggcggggacagcacccagaugaaccugacgcugugcgacaaccgcuucaaccgggaggugaagaaggccaagcuccccaccgagcuggccaaccacgaggagauccugacccgcaucgagcccuggaagaauaaguacgagcagcucgucaaggagagggacaagcagcgcaccuucgcgggcauggacaaagccgugaaggacauccggauucagaagcgccacaagcugcagauggagaucgacuacuggcggggcaaguacgagcgauucacgaugaccgaggugccggagggguucucccggcgccagggcaccgggaucggccugauaagccgguacgcaggccucuaccugaagucccucuuccaccaggccgacagccgcaacaaguccaacgucuacguggugaagggggucgccaccgcggaguuccggaagauguggggccuccagagcgaguacgagaagaagugccgcgacaaccacagccaccacugcauggacgccaucacgaucgccugcaucgggaagcgggaguaugaccugauggccgaguacuaccgcauggaggagaccuucaagcagggccggggguccaagcccaaguucagcaagcccugggccaccuucaccgaggacguguuaaacaucuacaagaaccuccuugugguucacgacacccccaacaacaugcccaagcacacgaagaaauacgugcagaccuccaucggcaaggugcuggcgcagggcgacaccgcccgcgggagccuccaccuggacaccuacuacggcgccaucgagcgggacggggagauccgcuacgucgugcgccggccccuguccaguuucacgaagcccgaggagcucgagaacaucguggacgagaccgucaagcgcaccaucaaggaggccaucgcggacaagaacuucaagcaggccaucgccgagccgaucuacaugaacgaggagaagggcauccugaucaagaaggugcgguguuucgcgaaguccgucaagcagcccaucaacauccgccagcaccgggaccugagcaagaaggaguacaagcagcaguaccacgucaugaacgagaacaacuaccuccuggccaucuacgaagggcuggugaagaacaaggugguccgcgaguucgagaucguguccuacaucgaagcggccaaguacuacaagcggagccaggaccgcaacaucuucuccagcaucgugccuacccacuccacgaaguacggccucccccugaagaccaagcugcucaugggccagcugguccugauguucgaggagaacccggacgagauccagguggacaacaccaaggaccucgugaagcggcuguacaaggucguggggaucgagaaagauggccgcaucaaguucaaauaccaccaagaggcccggaaggaggggcugcccaucuucagcacccccuacaagaacaacgacgacuacgcccccaucuuccgccaguccaucaacaacaucaacauccucguggacggcaucgacuucacgaucgacauccuggggaaggucacccugaaggaguga

SEQ ID NO: 7529 - RNA, 3657 nt, Artificial Sequence
  Cas9 variant
augaacaaacgcauacucggacucgacaccgggaccaacagccuaggaugggccgucguggacugggacgaacacgcucaauccuacgaguuuaucaaauacggagacguuaucuuccaagaagguguaaagauagaaaaaggaaucgaaucaucaaaggccgccgagcgcucaggcuacaaggccauacgcaaacaauacuucagacgccgccuccgcaaaauucagguccucaaagugcuaguaaaauaccaccuauguccguaccucagcgacgacgacuugcgccaauggcacuuacagaaacaauaccccaagagcgaugaacuuaugcuauggcaacgcacaucggauaagaaaggcaaaaacccguacuacgacagacacaggugccuccacgaaaaacuagaccuaaccguagaggccgaucgcuauacccuaggacgugcccucuaccaccucacacaacgccgcggcuuucuuagcaaccgccuagacacgagcgccgacaacaaagaggacggggucgucaaaagcgggauaucacagcuaagcacugaaauggaagaagccggaugcgaauaucucggcgacuauuucuacaagcuauacgacgaacaaggcaauaaaguccgaauccggcaacguuauaccgaccgcaacaaacacuaucagcacgaguucgacgcaauaugugaaaagcaagaacucagcuccgaacucaucgaagaucuacaaagagcaaucuucuuccaacugccccugaaaagccaacgccacgggguaggccgcugcaccuucgaacgcgguaaacccagaugcgcggauucgcaccccgacuacgaagaauuucgcaugcucugcuucguaaacaacauccaagucaagggcccacaugaccuggaacugcgcccccucaccuacgaagaacgcgagaaaauagaaccccucuucuucaggaaaucaaaaccaaauuucgacuuugaagacauagcuaaggcccuggcaggcaagaaaaauuacgcauggauacacgacaaagaagaacgcgccuacaaguucaacuacagaaugacccaaggagucccaggcugcccgaccacugcccaacucaaauccauauucggcgacgacuggaaaacagggauagcagaaacguacacacuaauccaaaagaaaaacggauccaaaucccuccaagaaauggaagacgacguuuggaacgugcucuacagcuuuucguccguagagaaacuuaaagaguucgcgcaccauaagcugcaacucgacgaagaaagcgccgaaaaauucgccaaaauaaagcuaagccacuccuucgcggcccuaucgcucaaagccauccgaaaauuccuacccuuccuccgaaaaggcauguacuauacccacgccucauucuuugccaacauacccacaaucgugggcaaagaaaucuggaacaacgaacagaaccgcaaauauaucauggaaaacgucggcgagcuaguguuuaacuaucagccaaaacacagagaaguccaagggaccaucgagaugcuuaucaaagacuuccucgccaacaacuucgaacuacccgcaggagcaacagacaaacuguaccacccguccaugaucgaaaccuacccccacgcacagcggaacgaguucggcauccuacagcucggaagcccucgcacaaacgccaucagaaaccccauggcgaugcgcucccuacacauccugcgccgcgucgucaaccagcugcuaaaagaaucaaucauagacgaaaacacagaagugcacguagaauacgcacgcgagcucaacgaugccaauaaacggcgcgccaucgcaggauggcaaaaggagcaagacaaacaacacaagaaauacguagacgaaauacgcaaacucuacaaagaggaaaccggcaaagacauagaaccgacacagaccgauguccugaaauuccaacuaugggaggagcaggaccaccacugccuauacacaggcgagcaaauaggcaucaccgacuucauaggcaguaaccccaaauucgacauagaacacacgauaccacaaucagucggcggcgacuccacccaaaugaaccucacacucugcgauaaccgguucaaccgcgaaauaaagaaagccaaacucccagcacagcucucgaaccacgaggagauccuggcaagaaucgaacccuggaaaaacaaauacgagcagaagauaaaagagcgggacaaacaacgcacguucgcaggcauggacaaggcggucaaagaccuccguauccaaaagagacauaaacuccagauggauauugacuacuggcggggaaaauacgaacgauucacaaugaccgagguucccgaaggguuuucacgucggcaaggaacaggcaucggacucaucucccgguacgcuggacucuaccuaaaaucacuguuccaccaggcagacagcagaaacaaaucaaacgucuacguggucaaagguguggccaccgcggaguuccggaaaauguggggacugcagagcgaauaugaaaagaaaugccgcgacaaccauucccaccauuguauggacgcaaucaccauagccugcaucggcaaaagggaauacgaccugauggcagaguacuaccgcauggaagaaaccuuccggcaagggcgcggguccaaaccuaaauucagcaaaccaugggcaaccuucaccgaagacguccuaaacaucuacaaaaaccuccucguaguccaugacacuccaaacaacaugcccaaacacacuaagaaauacguccaaacauccaaagggaaagugcuagcccaaggagacaccgcccgcggaucccuacaccucgacacauacuacggcgccaucgaacgcgacggcgagauaagguaugucguacgccgaccacuaagcagcuucacaaagcccaaagaacucgaaaacauugucgacgaaaccguuaagagaacaaucaaagaggccaucgcagacaaaaacuucaaacaagccauagcugaacccaucuauaugaaugaagacaaggggauacucaucaagaaagugcgaugcuucgcaaaaagcguaaaacaaccgaucaacauaagacaacacagagacuuauccaagaaagaauacaaacaacaauaccacguggugaacgaaaacaacuacaugcuaguaauauacgaaggacucgucaaaaacaaaguaguaagagaguucgaaauaguaagcuacaucgaagcggccaaauauuacaaacgcucccaagaccgcaacaucuucucgucuauaguacccacacacagcgcgaaguauggacucccccuaaaaacaaaacugcucaugggccaacugguacuaauguucgaggaaaauccagacgaaauacaagucgacaacacuaaggaccuggucaagagacuauauaaagugguaggcauuaagaaagacggccgaguaaaauucaaauuccaccaggaagcacgcaaggacggacuccucaucuucuccacgcccuacaaaaacaacaacggcuaugucccaauauuccgacacucaaagaaaaauauaaacauccucgucgacggcaaagacuucacaauagauauacucgguaagguuacccuaaaagaauga

SEQ ID NO: 7530 - RNA, 3660 nt, Artificial Sequence
  Cas9 variant
augaaggaggaggugcgcgguaagaauagaagccagaccugggccauccuggccaaguucuucgucugguccgagaaggagagcguguggaacgagaaggaggcgcgcaccgaggagcgggugaaagaguauaagcucgucgggcugaagcgcgacacgaagggcaacgagcugaagcucgagaacuaucgguggcgcgugcaggcacuguccgagcagcugaaccccgagaucguggccaucguccuccaggagaucaacgggcagaucagcgccuccagcggcuaucugggcgccaucuccgaucggagcaagcagcuguacuucaaccgccagaccgugggccaguaccucaugucugagcuggagaaggacccgaacgugagccugcggaacagagucuucuaccggcaggacuaccucgacgaguucgaccgcaucugggagaagcaggcggaguuccacgaggagcugaccguggagcugaagaaggagauccgggacaucaucaucuucuaccagcgccggcucaagucccagaagggccugaucagcuucugcgaguuugagaagcgcgagguggucguggaagaggacggucggaagaagaauaagaccgugggcugccgcgucaucccccggucccacccccuguuccaggaguucaagaucuggcagacgcucaacgacaucgagguguucgccugggacaagcagagcaagcgcaagaaggcagacaaguccagcauccuguucgacaacuccgaggacgcccuacucguggaggggaagagguuccuguaccaggaagagaaggagcugcucgcgaaggagcuguucguuaaggagagcaugaagaaggccgaggugcugaagcuccuauuugagaacuaccaggagcuggaccucaacuucaagcagaucgacggcaaucacacgggguucgcgcuguucuccgccuacagcaagaugaucgagaaguacggcuacgagcccguggacuucaagcgcagcgccgacgagaucaucgagaagcuggagaccaucuucaccaaccucggcuggaauacggagcugcuguccaucgaccucuccaaggaggacaaggagcuggagcgccaguccuacuuccggcucuggcaccuccuguacagcuucgagggggacaacaccccgaccggcaacgggaagcugcucgagaagaucaugcagcugugcgacgucgagaaggaguacgcgguggagcuggccaacguguccuuccaggaggacuacggcagccucuccgccaaggccaucaagaagauacugcccuaccugaaggagggcaaccaguacgacgucgccugcgacuacgcgggguaccgccacagccgauccagccucaccaaggacgagaucgagaacaagauccugaaggacaagcuggagauccugcccaaaaacucccuccgcaaccccguggucgagaagauccugaaccagauggugaaccugaucaacacccucaucgacaccuacggcaagccggacgagauccggguggagcuggccagggagcugaagaaaaacgccaaggagcgggaggaacucaccaagagcaucgcccgcaacacccgggaacacgacgagauccgccagcuucugcggacggaguucgggaugaugaacgucucccgcaacgacaucauccgguacaagcucuacgaggagcuuaaggacaacggcuacaagacccuguauagcaacgaguacaucccccgcgagaagaucuucuccaaggagaucgauaucgagcacgugaucccccaggcccgccucuucgacgacagccuguccaacaagacccuggaguaccgggcgaucaacauugagaaggggaacaagaccgcguacgacuucgugaaggagaaguacggcaacgacggccucgagaaguuccugaaccggugcgagacgcuguucaaggacaagcgcaccaagcuccggaagcugaagauggaggagaaggacauccccgagggguucaucgaccgcgaccugcgcaacacccaauacaucagcaagaaggccuucgccaugcucaacgagaucucccggcgcgucguggccaccacgggcagcaucaccgacaagcugcgggaggacuggcagcugguggaccucaugaaggagcuuaaccugccgaaguacgagaagcucgggauggucgagauguucgaggacaaggacggccgcaagaucaagaagauuaccgacuggaccaagcggaacgaccaccgccaccacgcgguggacgcccugacgguggccuucaccaaggacgucuucauccaguucuacaacaacaagaacgccgcguggaugcccgccagcaaggagcacgccaacaucaccgggaucaaggcccgguacuucgagaacgggaaggcccuggcacccaugccccucgcccaguuccgcgccgaggccaagcgucaccuggagaaccugcucguguccaucaaggccaagaacaaggugaucacuagcaauguuaaccgcacgaagaacaagaacggcgagaaccggaagcugcagcagaccccgcgcgggcaacugcaccucgagaccguguacggcucccaccggcaguacgcuaccaagaucgagaaggugaacgccgccuucgacgucacgaagaucgccaccgugagcaagcuggccuaccgcaacgcgcuucucaagcggcuggaggccuuugggaacgaccccaagaaggccuucaccggcaagaacacuuuagagaagaacccccucuaccuggacgagaaccagaccgagauggugcccgaaaagguccagacgguagaguucgagaccguguacaccauccgcaagccgaucgaccccaaccuguccaucgacaaggucguggacgugaagauaaggagcguccucgagaagcgccugaaggaguacgggggcgacgccaagaaggcuuucgugaaccuggacgagaacccaaucuggcucaacgaggccaagggcaucuccaucaagcgggugagcauccgcgggaucuccaacgcacagagccugcacgagaagaaggacaaggauggcaaccugauccucgggaaggagggacggaagauccccgucgacuucgugaacaccggcaacaaccaccacguggccaucuacaagaagccgguccuggacaaggugggccaggugguccuugacgaggaggggaaccccaaguacgaacucgaugaggugguggucuccuucuucgacgcagugacucgcgcgaaccuggggcagcccaucaucgacaaagacuaccgccggagcgaaggcuggcaauuccuguucuccaugaagcagaacgaguacuucguguuccccaacgacaagaccggguucaacccgaaggaagucgaccuccugaaccccgagaacuacgcgcugaucagccccaaccucuuccgaguccagaaguucgccuacaagaacuauguguuccggcaccaccuggagaccaccaucaaggacacgucaucaacacugaagggaaucaccuggaccgacuuccgcuccagcaagggccucgacaagaucgucaaggugcggguggaccacaucggccagaucguuagcaucggcgaguacuga

SEQ ID NO: 7531 - RNA, 3663 nt, Artificial Sequence
  Cas9 variant
augaaacgcauccugggccucgaccugggaagcgccucaaucggcugggcccugaucgaggaggacgagaaggggauccggaucaucgcgcucggcucgcggaucauccccuacaacgggaccgagggucaggacuucgccaagggcgccggggagucccgaaauagccuacgcacccaggcccggacgacccgcaagggguacgaccgguaccaacugcgccggaaauaccucaucaacgugcuggagaagaaucugaugaugccguccgaggaucuccgcaagaugcccaagaugaaccuguggcagcugcggagcaaggccgucaccgaguacaucucccgccaagagcucgggcggcugcuucucuggcugaaucagaaacgaggcuacaagagcucccggagugacgcgaaccuggauaagaaagacacggacuaugugaaggaagucaagucacgcuucgacaagaucaaggagaagaaccagacgaucggucaguacuucuacgaaagccuccagugcgacgaguacuuccgggucaaggagaacguguucccccgcgaggccuacaucgccgaguucgacgccauuugcucccggcaaaaggaccaccugggccugagcgaggagcucaucgccgagauccgaaacgagaucaucuacuaccagcggccgcugaagucccagaagggccuugugagcgucuacgacuucgaggggaaguggaugaaucagaacggcaaggagcuguucauugggccgaagguggcccauaaaucaagcccccucuuccagcuggccaagaucugggaguccgucaacaacauaaagcucucuacgaaguauggcgauaccaucgagcugacccuggaggaaaagaagcagcucguagaguuccuggacaacaacgagaagcugacgaccgccgcccucuucaagauccuacguaaggacaagaaggaguacauccugcccaagcagcucgagaagggccugcagggcaacaucaccaagugcaaaaucgcggacaucuugggcagcaaguacaaccaguuacugcagcugaaccucgagaagcaagagguggggacccccugcuaccuguacacgaaauccaccggagaagugcugggggaaaagccguuacaguacaucgacaaaagcgucgaaaaggaacuguucuaccagcuguggcacaccaucuacuccauuucugacgaggacgagugcugcaaggcccugcaaaagcgcuucgacaucgacgcugagaccgccggccgguuagccaagaucgacuucuccaaguauggcuucggaaacaagagcgcaaaggcuauccguaagauucugcccuaccuuauggagggcgacaaguauagcgacgccaugugcuacgccggguacaaccacagcaacucccucacgaaggaggaaaaccacgaacggaagcugaacgacaaguuaaagcuccugaccaagaacagucugcgccagcccaucguggagaagaucaugaaccagaugauccagcuagugaacacaaucaucgacaaguacggcaagccagacgaaauccggcuggagcuggcacgggaacuuaaacaguccaaggaggagcggaacgaugcggacaaagccaugagcaagcgccagcgggagaacaaggaggccgaaaagaaacuggaggagcacgggauccgcgccacccauaacaacaucuugaaguaccgccucuucgaggagaugggagaaaagaagcacgaggccaucugcaucuacugcggcaacccgaucaguuuuagcgcggccaugaacggggacgaggucgacguggagcacaucaucccucgguccaagcuguucgacgacagccaguccaacaagacguuagcccacagaaaguguaacgccaacaagaacgauaugacugcguaugauuuuaugaagaccaagagcaaacaggacuucgacaaguacguggagcgcguaaaccagcucuacgccgaccgaaucaucucccgcagcaaauacaacaagcugcugaugagcgaggacgacauucccuccaacuucaucgaccggcagcuccgcgaaagccaguacaucgccacgaaggcccgggaaauccugcagacgaucugcuacaacguuugguccaccagcggcaccgugaccgccgagcugcgccaccucugggggugggacgacaucacaaugaacuuacaaaugcccaaauacaaggagcugggccucaccgagauggucgaguggaccuccgaucacggaaagaacgugcacucgaaggagguuaucaagggcuggacgaagcgcgacgaccaccggcaccaugcgaucgacgcccuaacgauugccugcaccaagcaaggcuucauccaacgcuucaacacccuguccagcucuaagacccgggacgacaugcagaaggagcucgagaagugcagcauucaguuccgcgagaagcggucccugcuagagaaguacaucaucagccagcgcccgauauccgugagcgacguggccgaggccguaucucggauucucauuucuuucaaagcggggaagaaaguggccaccauaggcaagcgcaagguaaaggggaaagucgugcagcagggcaucguggucccccggggcgcccuguccgaggggagcguauauggcaagauucgaacuaucguccggaagaugcccgugaaguaccuguucgaaaaccccgaccugaucuuuaagccguacaucaaggcucuagugaaggagcgccuggccgaguucgacaacgacaauaagcaggcauuggccagccugaagaagaaccccguguaucuggacaaggagaagacuaagcuccuagaguacgggaccugcuucaaagacgaguacgucaaaaaguacgacgucaaccccaacuucaccaagaucgccgacgugaucgacggcaaggucaagcagauccuggaggaccggcucucuaaguucgggggcaaacccaaggaggccuucaaggacguggugaaggacggcaaaacgcugaagugguacgaggacgaggggcuagagcgcccuauccgaagcguccgcugccucaccggcuuguccgcgguggugcccgucaagaaggacgagaacgguauggacauaggcuucgugaagcccggcaacaaccaccacguggccaucuacgucggcgccgacggcaaggggcaggagcacgugugcaccuucuggaaugcaguggagcggaaaaaguacgggcugcccaucaucaucaaggacgcgaacgaggucugggacaagaucaccauggcgggggacgacguguacccucagagcuucuuaucccuguugccuaagcccgacuggacguuaaagcugagcaugcagcagaacgagauguucauucugggcauggaggaggacgagguaaaguucgcuauagaguccaaggacuacaaacuccugagcgaccaccuguaccgcguccagaagcucuccagcuccgacuauaacuucauccaccaccuggagaccgacgugcagaagaagaccaugaccuaucgggugcgcagccuguccggucucuucgccuugcggccguucaagguccggaucgacugccuggggaacaucauccccagcuga

SEQ ID NO: 7532 - RNA, 3669 nt, Artificial Sequence
  Cas9 variant
augaagaagcgcauccugggccucgauagcgggacuaacucccugggcugggccgugguagaccgggacgagaacaaucaguacagccugaucaaauacggggaccucauauuugaggagggcgugaagaucgagaaggggguggaguccagcaaggcugcggaacgcacaucccaccgggcucugcgcaaacuuuacuuccggcgacgacuccgcaagaucgagguccugaaggugcuggugaaguacaaccucugcccccaggucagcgaggaggagcugcaccuguggcacacgcgaaagcucuacccucagaauaaggaccugcugcaguggcagcgcaccgacgagaaggccgggaaaaaccccuacaucuaccgguaccgcugcuugcacgaggaguuggacauguccgugagcgccaaccggaugacugugggccgcgccauguaccaccuggcgcagcggcgcggguuccucuccaacagacuggacaacgaggaggacgagaaccaaaucggcgcgguuaagugcgggauaagcaaccucaccgaggagauccaguccucuggcugcaaguaccucggggaguacuucuauaagcuguacaacgagcacggcaacacggugcgccugcggacccgcuacacaucccgggaguuccacuacaagaaggaguucuacgccaucugcgagaaacagaagcucgacaagaaacuuaucgaggagcuggccagcgcgcucuacuuccagcgcccccugaagucccagcgccacaccgugggucggugcacguucgagcccaauaagccgcgcugcgccgacagccaccccgccuacgaggaguuccggaugcuguccuucaucaacacaaucaagguacaggggcccuacgacaccgagcuccgugugcuaaacaccgaggagcgagauagcaucacgaagcuguucugccgcaagagcaagcccaacuucgacuucgaggacaucgccaaagagcucgccggccguaacaauuacugcuacaucggugacgugguugacaaagcguacaaguucaacuaucgcaugagccagggcgugagcggcugcccgaccaccacguaccugaucaacguguucgggcaggacuggcagaccggcaucgccgaguccuaccaggcgaucgacaccaaacuggggcaaaagucagucgacgccaugaucgacgauguuuggaacgugcucuacuccuucagcuccaaggauaaguuacgggacuucggccgcaagaagcugcagcucggggacaaggaggccgacaccuucgcaaacauaaagcugacccacaaguucgccagccugucccucaaggccauccggaagaucaacaucuuccugcgcaugggccuagucuacagccacgccgugacgcucgccaauauccccaccaucgugggcaccgacaucuggcagcggaagaggaacuucauccuggcggaguuacucccccugaucgagaacuucaacccuaaggagacaaagcugcaggaaacgcuggacuucugcgucaaggacuuccuccagaacaacuuugaacugaagaacggggcuguggacaagcuguaucacccguccaugaucgaggcuuaucccgacgccggccucaacuccaacgggauccugcagcugggcagcccacggaccaacgccauccgcaacccuauggcgaugcggagccuccacgagauccgcaaggucaucaaccagcugcugaaggauaaaaucaucaaccaggacaccgaaauccacguggaauacgcccgagaguugaacgacgccaacaagcggaaagcuaucucuaucuggcagaagucccaggagaagcugcacaaaaaguacguagaggaaaucaccaaccuguacaaggaggagacggggaaggcgaucgucccgaccgacaccgacauccuaaaguucaagcugugggaagaacagaaccacaucugccuuuacaccggccagcagaucggcaucgccgaguuccucggcgccacgcccaaguacgacaucgagcacaccaucccccagagcgugggcggugacagcaccgauaugaaccugacccugugcgacucccgcuucaaccgggagaucaagaaggcacagcuccccacccagcugggcaaucacgcggacauccuggugcgcaucgcuggguggaaaaacagcuacgagaagcuaagcaaggacaucgaucgaauacggacccacagcggcauggccaaggacaucaaagaucggcugauccagaagcgccaccuccugaagcuagagcgcgacuacuggcgcggcaaguacgagcgguucaccaugaacgagaucccggaggguuuuagccgacggcagggcgucgggaucggccugaucuccaaguacgcgggcuuguaccucaaaagccuguuccacgacaagaacgagaggaacaaggggcacguguucguggucaagggcaccaccacggcugaguuccggaagauguggggacuucagaacgaguacgagaaaaagucccgcaacaaccacgugcaccacugcaucgacgccaucaccauugcaugcaucggaaagcacgaguacgcucaaauggcccaguacuaccacgacgaggccgaauaccuguaccaucacggaaucaagccaaucuuccccaagcccuggaagaccuucaccgaggaccugcucgacuuagagcauucccuguucgucguccaccacuccccgaacaacauggcaaagcaggcgcgaaagcgcaucaucacgucuaccggccagcacugggcccagggcgauuccgcccacgggagcuugcacaacgauacguauuacggcgccaucgagcgggacggcgagaucaaguacguggugcgccgggcgguguccagcuucgaacagauguccgacgucgacagcaucguggacgacgucgugaaggaaaccgugcgcaaagcacuugagggcaaaaacuucaaggaggccgucaacgcucccauauacaugaacaaggagaagggggugcugaucaagaaggugcggugcuacgccaagucaauuaagaaaccgaucgacauccgcacgcaccgcgacucauccagcaaggaguauaagcggaaguuccaugucuccaaugacaucaacuaccucaucgcgauauacgagggcaccgugaagggcaaggugaagcgcgacuucgaggugguaaagaacaucgaggccgccaacuucuuuaaacggucccaggaccggcgggacuaucccaccaucgugccggagaaguccaucaagcacggguucccccugaagaccacgcugaccaacgguacaaugguuauccucuacgaagagaacaaggaggagaucgacuuuaccaagaaggaggauaucugucgccggcuuuacaagcucgugggcaugagcagcaugaucguuuccggcugcgaguacgggguccucucacugcgccaccaccaggaggcccggcccuccaaggacaucaagucaaagaacggcgccuucaagaacggcgaggcgcugcgcccggcuaucacuaugcuccacacccaguucaaugcccugguggaaaacaucgacuucaacaucgacgugaccgggaauauagagcuaaucuga

SEQ ID NO: 7533 - RNA, 3669 nt, Artificial Sequence
  Cas9 variant
augaagaagcgaauccuggggcucgauagcggaaccaauucacugggcugggccguggucgaccgggacgagaauaaccaguacagccugaucaaauacggggaucucauuuucgaagagggcguaaaaauagagaaggggguggaguccagcaaggcggccgagcgcaccucccaccgggcccugcgcaagcuguacuuccggaggcggcucaggaagaucgaaguccugaagguccuugugaaguacaaccuuugcccccaggucagcgaggaggagcugcaccuguggcacacgcggaagcucuacccgcagaacaaggaccugcugcaguggcagcgcacagacgagaaggagggaaagaaccccuacaucuacagauaccgcugccugcaugaggagcuggacauguccgugucggccaaccggaugaccgugggccgcgccauguaccaccuggcgcagcggagaggguucuuguccaaccggcuggacaacgaggaggacgagaaccagauaggagcggucaagugcggaaucagcaaccuaacugaggagauccaguccagcggcugcaaguaccugggggaguacuucuacaaacuuuacaacgaacauggcaacacggugcgccuacggacucgcuacaccucccgggaguuccacuacaagaaggaguucuacgccauaugcgagaagcagaagcucgacaagaagcugauugaagaacuggccagcgcccucuacuuccagcgcccccugaagucccagcgccacaccgugggccggugcacguucgagcccaacaagccgcgcugugcggacagccaucccgccuaugaggaguuccggaugcuguccuucaucaacaccaucaagguccaggggccuuacgacaccgagcuccgcgugcugaacacugaggagcgggacagcauaacuaagcuguucugccgcaaguccaagcccaauuucgacuucgaggacaucgccaaggaacuugccggccggaauaacuauugcuauaucggggacgugguagacaaggcauacaaguucaacuaccgcaugagccagggcguaagcggcugcccgaccacaaccuaccugaucaacguguucgggcaggacuggcagacgggcauagcugaguccuaccaggcaaucgacacaaagcucgggcagaaguccgucgaugccaugaucgacgacguguggaacgugcucuacuccuuuagcuccaaggacaagcugcgggacuucggccgcaagaagcuccagcucggugacaaggaggccgauaccuucgccaacaucaagcugacccacaaauucgcgagccugucccucaaggcuauccggaagaucaacaucuuccugcggaugggccuggucuacagccacgccgugacgcucgccaacauacccacgaucguugguaccgacaucuggcagcggaagcgaaacuucauucuggccgagcugcucccccuaaucgagaauuucaacccuaaggagaccaaacugcaggaaacgcuagacuucugcgucaaagacuuccuccagaacaacuucgagcugaagaacggcgcaguugacaaacuguaccauccguccaugaucgaggccuaccccgaugccggccucaacagcaacgggauacugcagcugggcagcccccguaccaacgccauccgcaaccccauggccaugcggagccuccaugagauccgcaaggucauaaaccagcugcugaaggacaagaucaucaaucaggacaccgagauccacguggaguacgcgcgggagcucaacgacgcuaacaagcgcaaggccaucagcauuuggcagaagucccaggagaagcugcacaagaaguacguggaggagaucaccaaccuguacaaggaggagacggggaaggccaucgucccgaccgacaccgauauccucaaguucaagcugugggaggagcaaaaccacaucugccuauacaccggccagcagaucggcaucgcagaguuccucggggcgacgcccaaguacgauaucgagcacaccauuccccagagcguugguggggacagcaccgacaugaaccugacccugugcgacucccgcuucaaccgggagaucaagaaggcacaguugccuacgcagcugggcaaccacgccgauauccuggugcgcaucgcgggguggaagaacucuuaugagaagcucuccaaagauaucgaccgcauccgcacccauagcggcauggcgaaggauaucaaagaccggcucauccagaagcgccaucuccugaagcuggaacgggacuacuggcgcggaaaguacgagcgguucaccaugaacgagaucccagagggguucagucgccgccaaggcguagggaucggccugaucuccaaguacgccggccucuaccuuaagagccuguuccaugauaagaacgagcgcaacaaggggcacguuuucguggucaagggcaccaccacggccgaguuccguaagaugugggggcugcagaacgaguacgagaagaagucccgcaacaaccacguacaucauugcaucgacgcuaucacgaucgcuugcaucggcaaacacgaauacgcgcagauggcccaguacuaucacgaugaggcggaguaccuguaucaucacgggaucaagccuaucuuccccaagcccuggaagaccuucaccgaggaccugcucgacuuagagcacagccuguucgugguccaccacuccccaaacaacauggcaaagcaagcccggaagcgcauuaucacgagcaccggccagcacugggcgcagggcgacuccgcccacgggagucuccacaaugacaccuacuacggcgccaucgaacgggauggggagaucaaguacguggugagacgcgcagucucgucauucgagcagauguccgacguggacagcaucguggacgacgucgugaaggagaccgugcgcaaagcgcucgagggcaagaacuucaaggaggccgucaacgcccccaucuacaugaacaaagagaaaggggugcuaauuaagaaggugcggugcuacgccaaauccaucaagaagcccaucgacauccggacacaccgcgacagcaguucaaaggaguacaagcggaaguuccaugucuccaacgacauaaacuaccucauugccauuuacgagggcaccgugaagggcaaggugaagcgcgacuucgaggucgugaagaauaucgaagcggccaacuucuucaagaggagccaggaccgccgggauuacccgaccaucgugccggagaaguccaucaagcacggguuuccccugaagaccacgcugaccaacggaaccauggucauccucuacgaggaaaacaaagaggagaucgacuucaccaagaaagaggacaucugccggcggcuguacaagcugguggggauguccagcaugaucguguccggcugcgaguacggagucuuaagccugcgccaccaccaggaggcccggcccuccaaggacaucaagagcaagaacggcgccuucaagaacggcgaggcccugcggccagcgaucacgaugcuccacacccaguucaacgcccucguagagaacauagacuucaacaucgacgugaccgggaacauugagcugaucuga

SEQ ID NO: 7534 - RNA, 3678 nt, Artificial Sequence
  Cas9 variant
augagcaagcgcauccuggguaucgacguggggacaaacagccucggcugggcggucgucgaucggacggacugcgacaacuacacgcuggucaaacgcggggacguuaucuuccaggagggcguuaacaucgagaaagggaacaucgaaaagucccgggcgagcgagcgcaccgggcacaggagcacaagaaagcacuacuuccggcgcaggaugcuaaagauaaaggugcuugaaaucuuggucgagcaccagcugugccccuaccucagccacgaggaacugcaccaguggaugacacguaagguauacccaaccaacgaagacuucagacuguggcuccgcacgaacgacgcgaacgaccaaaaccccuaccacgacagacacgugugccuccacgagcgccuggaccucaggcugcaggagaaccgcuauaggcuuggccgcgcacucuaccaccuggcccaacggagagguuucuugagcaaccggcucgaacagaacuccaagaccgacgagaccggcgccgucaagagcgauauaucccaacugaacgaagagaugaagaaagccggaagccaguaccugggcgacuacuuuuacuggcucuaccaggaguacggcaaccaagugacacuccgcaucagguauaccgaucggaaacagcacuaccagaaggaguucgaagcgaucugccagaggcagcaacuguccgacgaucugguagacaagcugaggagggcuauuuacuuccagcggucucugaagucccagcgcgccggagucggcaagugcacauucgagcccgacaagccccggugcgcccucucccacccgagguacgaggaguuccggaugcuguccuuccugaacaacgucaaagugaaggggcccagcgaugacucgcuccgcccccugagcccaagugagaaagagaaaauuaagccguuguuccuccgcaagagcaaggcuaacuucgacuuugaggacaucgcgaaagccaucgcgggcaaggggaaguacgccugcauccgggauaaagagggcgcgcagaagccuuaccaguucaacuaugcccugucgcagggcgucuccggcugcccugugacugccaaauuaaucgccguauucggcgaauccugggagcguaaccucgucaacgccuauagaucacgaaacgacaugcgcaagagcgaugaggagaucgugaacgagguguggaacguccuguauuccuuuucuuccaaggagaagcucagggcaugggguauggaaaaacucggccuggaugaggccugcgccggugaguuugccgacaucacucugcccacagcauucgcggcccugagucugaaggccgugaacaaaauacuaccuuuccucagacagggcuucaucuacucccacgccgugaugcuagccaacauccccuacauuaucgguauggacagauggaacgagccccgccagcgucaguucaucauggacaacuuacaggagcuccuggacaauuucaccgcgagcgacaaagcccugcagcaaacguuagacuucuguauuaaggauuucuuacugaacaacuacgagcuggccccugggaaggccgaccgacucuaccacccguccaugaucgagacguaccccgaugcaaaggccgacggccaagggaucuaucagcugggcuccccagccaccaaugcgauccgcaacccaauggccaugcgcucccuccacauccucagaagagugguuaaccaguuacuuaaggagaagaccauagacagcgagacagagguacacaucgaguaugcgagggaacucaacgacgcuaaccggcguugggcaaucaaccaguggcagcggaagcaggagacacagcgcaaggauuacgccgagaagauccggaaaguauacgcggacgaguuugaaaagguuaucgagccgacccaggaagaguugcucaaguaccagcucugggaggagcagcagcaccucugucuguauaccggggagcagauuggccuuaccgacuucaucggcccuaaccccagauacgauauagagcacacgaucccccagucgaugggcggugacagcacucggaugaaccugacccucugcgaacgcaccuacaaccggacggucaaggggaacagaaugccgucgcaacuggcggaacacgagagcaucuugacccggaucaagcccuggaaggacaaguacgaggagcugaccgugaagaucaauaaacuacgcacacaccccgguauggacaaggccuccaaagacaauauuauccgcaagcgccaccuccuagagcuagaacgcgauuacugguuccagaaguaccagcgcuucacgaugacggaggugcccgagggguucagccugcgccaaggaacuggcaucgggcugaucggaaaguacgccgggcuguuucuuaagucacuguuccaccacgucaaggagcgaaaucgcaaacaagucuacguaaucaagggcccgaucaccgccgaauuucggcgccucuggggccuacagaaccucuacgagcaaaaaucucgggauaaccaugcccaccacugcaucgacgcgaucgugaucgcaugcauuaauccugccgaguacgcucgcauggcaagcuacuaccggcaggaagaggacuucaggcucaacaaggggaauaagcccguguuuccgaagcccuggacgaccuucacucaggaccuucaggcccuggaagccgagcucuuagugguacacgaaacccgcaacaaccugacgaagaaggcccgcaagcgagugcgcacgaagggcgggaacgugcucuccgaaagcgacuccgcccggggcagccuucacaacgacaccuacuacggagcaauccagaaggacggcgucauccgcuacgugguccguaaggcauuauccucccucuccgagaaagacgucaaagacauuguggacaaaacggucagagagaaggugcaggccgccauccaggaaaagggugccaaagaggcgcuggccgggacgaucuacaugaacgaggaaaagggcaucacaaucaagaaaguccggugcuucaccaagaucgccagcccacuggccauccgacgccauagggacgcguccgcuaaagaguauaagcgaccuuacuacgugaccaacgagucuaacuacgucauggggaucuacgagggcugcauaaaagagaagacuaagcgggaguucauccucgugaacaaucuggaggcagugagacagcugaaggccgcgagaaaacagggggucgucucaagcauccugccgcccguauccgcaaaaucacaauuuccccugaaguaccgccuuuacacgggcaccuugguccugcuuuacgagaacucccccgaggagaucgacuucaccaaucagguggacaucugcaagagauuguacaaggugaccgggcuuagcagcaugacgguaacaggaaaccaguacgggacgauccagcugcgcuaccaccaagaagcccggcaagccaaggaucucaaggcucaaaacggggccuacaaggagggugaggaacaccgccccgcuaucaugaugcugcauacccaauucaaggcccugguggaggggacggacuuccggaugaacauccucggcgagaucgagccccugcgcaaguga

SEQ ID NO: 7535 - RNA, 3690 nt, Artificial Sequence
  Cas9 variant
augggcgaccguaaguacaaccuggggcucgacaucggcaccucuuccaucggguucgccgcaguggacgagaacaaccagcccauccgggucaagggcaagaccgcgaucggugugcgccuguucgaggagggcaagacggccgcagaccggcgcggcuuccggaccacccgccggcgccugagccggcgccgguggcgcaucaaccuccugaacgagaucuucgacgcccaccuggcggagguggacccgaccuuccucgcgcggcugaaggagucgaaccgcagcaaccuggaccccaagaagucuuuccaggggagucuccuguuccccgagcggaaggacuaccaguucuacgaggaguacccaacgaucuaccaccuccgcaaggcacugauggagaaggaccggaaguucgacauccgcgaaaucuaccuagccguccaccacaucaucaaguaccggggcaacuuccugaacgguacccccaugagaucauucaagguggagaacaucgagcucaacacccuguucgaccaacugaaccagcucuacgccgagaucgucccagauaacgagcuggcguucgacuuagcgcaggucgccgacgugaaggacguguuaagcuccaccacgaucuacaagauggacaagaagaagcagcuggucaagaugaugcugcuccccgccagcaacaaggcccugcaguccgagaacaagaagauagugacccaguuugugaacgcgauccugaacuauaaguucaagcucgacguucugcuccagguggagaccgacgccgacuggagccugaagcugaacgacgagggcgccgacgauaagcuggaggaguucaccggggaccucgacgagaaccggcuggagaucaucgaccugcuccagcgccuacacaauugguucucccugaaugagaucacgaaggacgggaauagccucuccgccgccaugguggagaaguacgagaaccaccaucaccaccugggccuccucaagaaggucaucgagaaccacccugacgcgaagaaggcaaaggcccugaaggagaccuacaccgccuacguagggaagaccgacgacaagacgcagaaccaggacgacuucuacaaggccgucgagaagaaccuugacgacagcccggaugcgaagggcaucaaacgccucauccagcuggaccaguucaugcccaagcagcggacagggcagaacggcgccaucccccaccagcugcaccagcaggagcucgaccagaucaucgagaagcaguccaaguacuacccguuucuggcagagccgaaccccaacgucaagcggagaaaggacgcccccuacaaacuugacgagcugaucgcguucaagauccccuacuacgugggcccgcucgugacccccgaggagcaggcgcagaacaaggagaacgucuucgccuggaugaaacguaaggccgccgggcccaucacccccuggaauuucgacgagaagguggaccggauggagagcgcgaaccgcuucauccggcgcaugacgaccaaggacaccuaccuguuuggcgaagacgugcugccggccgaguccaugaucuaccagaaguucgucgugcucaacgagcugaacaaccugaagaucaacgggcggcaccucagccugaaggacaagcaggacgucuacaacgaccuguucaagcaacagaagaccgugagcaucaaagcccuccagaacuacuacgugacuaagaagaaggccgcuacugcccccaccgucggcgggcuggcugaccccaagaaguuccugucaagccucuccaccuacaucgacuucaagaacauguucggcgagcgcguaaacgacccccaguuccaggaggaccucgagcaaaucguggaguggagcacgaucuucgaggaccggggcaucuucaaggccaaacugcaagcccucggguggcuuuccgagaagcagauucaacagcuggucgccaagcgcuacaagggcugggggaggcucucaaagaagcugcugaccggccucaagaacgcggagggguacuccauccuggacgaaauguggcgcagcacugagaacuucaugcagauccaaucccggccggaguucgccgcucugauccagcaggccaacgagaagcaguucgagggcaacgaccccgacaaugugugggagaacauagagaacauccucggcgacgccuacaccagcccccagaacaagaaggcgauccgccaggugguaaagguugugcaggacaucgagaaggcggucgguaauccgccagagaagaucgcgaucgaguucacgcgggaggccgcagccaacccccaacgcacccagucccggcugcgcacccuggagaaguuguacgagagcgccgaggaggugguggaugcaggccugaccgccgagcuggcggaguucaaggagaacaagcacguucuauccgauaaguacuaccuguacuucacgcagcuggggcgcgauguguacaccggcgacacgaucagccucgacaagcuaaacgacuacgacgucgaccacauccugccccagucauucaucaaggacgacucgcucgacaaccggguccuaaccauacgcgccgugaauaacgggaaguccgacaacgugccggccaagauguuuggcaagaagaugggcucauuuuggcggcaccuccucgacaacggaaugaucuccaagagaaaauacaacaaccugaucaccgaucccgacaacaucuccaaguacgcccagaagggcuucaucaaccggcagcugguugagacgagccaagugauaaagcucaccgccaacauccugaacgggaucuacgacaaggacacagagaucaucgaggugcccgcgaagaugaacucccagaugaggaagauguucgaccuggucaaggugcgggaggugaacgacuaccaccacgccuucgacgccuaucucacgaucuucauuggcaacuaccuguacaagugcuaccccaaauuacgcccguacuucgucuacgacaacuucaagaaguucggcaacaaggaggacaucgggcacaagcgguuuaacuuccucggcaagaucgagcgcgagaagaaggugguggccccagagacgggggagauucuguggaguaacgucgcccccaacgagaccaucaagcagaucaaaaagguguacaacuacaaguucaugaucgugucccgggagaucaccacccgccgggcggagcuguucaaccagacagucuacccuaagaauuaccgcggcaagcucaucccuauuaaggaggaccggcccaccgaccuguacgggggcuauagcggcaacaccgaugccuaccuggcaaucguggcccucgaggacaagaagaaggggaaguacuucaaaguggucggcauccccacccgcgccgccgccaagcuggagaagcugaagcagcaggacucccagcaguaccuccaggcccugcacgaggugaucgcgccccaauucaccaagaguacgaagaaggggaucaagaagaccgaguucgagaucgugcuggacaaaguccacuaccggcagcucgugcaggacgggccggugaagaugaugcugggguccagcaccuacaaguacaacgccaagcagcugguccuguccgaaaaggcacuguga

SEQ ID NO: 7536 - RNA, 3696 nt, Artificial Sequence
  Cas9 variant
augaucacaagaauccucgggcuagacacuggcaccaacucucuagccugggcaguggucgaccgagacgccaacggcaacuacacccuaguuaaacgcggagaugugauauucaccgaaggaguaaaaaucgagaaaggaaucgaaucaucuaaagcugcagaacgaacugcccacaaagcccuccgagugcacuacucacgaagaagacuccacaaaauagacacccucaaaguccuaguggaacuagaccucugccccuaccuaagcaacgagcaacuaaauuuguggaaagcgaagaaaacguacccccucaccgacgauuuuaugcucuggcagcgcaguggcagcgcugaagaaaacaacccguacuacugccgacacagaugccuaacucaaaagcuagaccucacagaccaaucccaacgcuuucuccuuggccgggcguucuaccaccuggcccagcgccggggcuuccugucaaauagacucgauaccuccgcagacucggacgaguccggaaaaguaaaaagcgguauagccgaacuguccguggagauggagaaagcagggugcgaguuccucggggaauacuucuaucaguuauacaaacagcacggaaacaccauuaaacuccgaagccgcuacacagaccgcgaggaacacuacaaaaaggaguuucucgcaauaugcgaaaagcaagaacucgaccccaaauggguggaagcccuccaacgcgccaucuacuuccaacgaccacuaaaaucucaacgaaaaggcgugggcaaauguacauucgagcccaagaaaccacggugcgcagagagccacccagacuacgaagcauuccgaaugcuuuguuuccugaacaacgucaaaauacaaaccccuaacgacacaagccugcgcccacuaaaugaagacgagcgcgagaaaauuuggccacucuucuuccgcaaaagcaaacccaacuucgacuucgaagacaucgcgaaggcauuagcggggaaaaacaacuacgcaugguacaaggacgcaggagaaaaacccuuuaaguucaacuaccgcaugcaacaggggguaucaggaugucccguaacagcccaacuaaucgauaucuucggcucagacuggcagacagccaucgcggaaacauacacagccgucgaaaagaaaaacgggaccaagaccaucgacgaaauggcagacgacguauggaacgugcuauacagcuucagcucaaaagacaaacuaaaggccuucgcgaccgagaaacuacaacucgacgaagccagugcaacuaaauucgccaacgcgaaauuaccacauggcuucgccagccucucguugaaagcaauacgcaacaucuuaccauuccuuaggcagggcuucaucuacgcccacgcaguccaccuagccaaaauccccgacauagucaccaaagccgucuggaacgacgcagacaagcgagaaaugauccuaagcggccucauggaaaucaucgaaaacuacaaccccaaagaccgaggcguagaaggaaccaucgacuuuugcauaaagucucaccuccaagacguaauagaccucagaccaggcgccgccgacgcacucuaucacccaagcaugaucgaaaccuacccagacgccaaacuaaacaaaaugggcguguuccaacuaggcagcccacgaaccaacgccauccgcaaccccauggccaugcgaucucuccacauccuacgaagcgucguaaaccaacuacuccgugacggaauaaucgaucguaacacugaagugcacgucgaauacgcucgcgaacuaaacgacgcaaacaagaggaaggccaucgccgauuaccaacgcgaacaagaaaagaaacgcaaacaguaccgagacgauaucauagcccuauacaagucagaaugccacaaagaaauagaacccacagauaccgacauccucaaauuccagcuuugggaggagcaagaucaccugugccucuacaccggcacucaaaucgguaucugcgacuuucucggcgacaaucccaaauucgacaucgaacacaccgucccucgcuccguagggggcgacucaacccaaaugaaccugacccuaugcgacgcaaccuuuaaccgucaaguaaaaggagcccaacuccccagccaacuauccaaccacgccgacauccucguccgcaucgaccacuggaaauccaaaugcgaagaccuccgaaagcaacuugacaaaauacgaaccuacggcggcauggaaaaggccaugaaagaccgccucauacaaaaacgccaccgacugaagauggaccucgacuauuggcaagggaaauacucgcgauucacuaugacagaagucccagaaggauucagccgaagacagggggcaggcauaggccucgucucgaaauacgcgggccucuuccuaaaaagccucuuucacaacgagcaaaacccuaacaaguccaacguauacguaguuaagggggucacaacagccgaguucagacgcaugugggggcuccaaggggaauacgaaaagaaaucccgacucaaccacugccaucauugcaucgacgcaauaacgaucgccugcauaggaaaagccgaauaugauaaaauggcccaauacuaucaugacgaagaacuguuccaauggcggggcaccaccacgaaaccccacuucaacaagcccuggcccacguucaccgaggacguacucgcaauagaacagagccuccuaguaaaacaccuuacaaaagacaacaugcccaaacaggcuaagaaacgggugcgcacagcaacaggaaaauaccucgcgcaaggagacacagcgcgaggcagucuacacaaagacaccuacuacggcgcaauugagcaagacggggaaauccgauacguccuacgaaaaccccuaaauaaauucgagaacgaggccgaacuagaaaagaucguagaccaggcugugaaagagaaaauaaaagaagccauagccggcaaaaacuuuaaaacagcaaucaccgagccaaucuucaugaauaaagaaaaaggcauacggauuaacaaagucagguacuacgucaaagcgcaagaacgccucaaaauccgacaacaacgagaucuguccagcaaagaauacaaacaauucuucugcgucgagaaugaauccaacuacuugcucgccaucuacgaaggagaacucaaaggcaagaaagaacgcgacuucugcgucguuaauaaccuggagucagccgcaugccuaaaacgauccaauaaaggcaaagcagccccgcucguuccagaacgcagcgaagagagaaaucuaccacuacuugcaguccuaaaacgaggaacccaaguacucuucuaugagaacagcccagaggaaauccuguucgacaacccgcaagacuuagugcgaaggcuuuauaaagucacuggaauaaauacgaagaaagacgucaagaacggaaagacauaccuauacggcaacaucgaacuacguuuccaccaaaaugcacagaagaaagacgacgugaagaugcaaagcgggguguacaagaacaaugaaguucuccgccaaggcauaguccucucacacaagcaauucaaagcccuaguugagggcgucgacuucgaguucaacguacuaggagaaaucaaaaagaaagaaagacacgccuga

SEQ ID NO: 7537 - RNA, 3699 nt, Artificial Sequence
  Cas9 variant
augaccaaaacccggauccucggccucgacacggggaccaacagccugggcugggccaucguugaccgggacgaggucuccgggcaguacgagcugguggaccgcggcgaccucaucuucaccgagggggugaagaucgagaaaggcaucgagagcuccaaggccagcgagcggacccagcaccgcgcguuacggaagcaguacuuccgccggcggcugcggaagaucgagguccuccgcgugcugacguucuaccaccugugcccgcccguguccgaggaggagcuccaccuguggcacgucaagaagaucuacccgguggagaaccacgaguucaugaucuggcagcggaccaacgacaacgagggcaagaaccccuacuacuaccgacacaucugcuuacacaccaagcucaaccugacccugaugaaggaccgguacauucucgggcgcgcccuguaccaccugagccagcggcgcggguuccucuccaaccggcuugaccagagccaggacgaggacgacaaggggacggugaagaccggcaucuccagccugucaaaggacaugaacgaugccgggugcaccuaccucggcgacuacuucuacaaacuguacagcgagaacggcaacaggguccguauccgcaaccacuacaccgcccggaacgagcacuaccuggccgaguuugaagcgaucugccaggugcagaagcucgagcccgagcugguggaggcccugcgccgcgcgaucuucuuccagcggccgcucaagucccagcgcaagggggucggcaagugcacguucgagccccggaagccccgcugcgccgacagccaccccgacuacgaggaguuccggaagcugugcuuuaucaacaacaucaagauccagaccuccgacgacgacaccaugcgcccgcucaacaaggaggagcggcagcgcaucaacagucucuucuacaggguguccaaggcgaacuucuacuucgaggagaucgccaagcugcuugggggccgcaacaacuacugcuacuucaaggacgaggugcagaaggacuucaaguucaauuaccggaugagccaguccgucagcggcugccccaccacggcccagcugcgcaacaucuucggggaggacuggaagaccggcaucgccgagaccuaccagcacagcgccaagaaggacgggucccugaagacuguggacgagauggcggacgacaucuggaacgugcuguacagcuucuccagcaaggauugccucuacaacuucgccgucaacaagcugcagcuggaggaggacaaggccaagaaguucuccaagaucaagcucagccauggcuucgccuccaucagccugaacgccauccacaagauccuucccuuucuccggauggggaugaucuacucccacgcuguccuguucgccaauauccccacaaucguaggcauggacgucuggaacgacgagagcaagcgccagcacaucaugaccgagcuguccgaccugguguucaacuacgacccgaagaaccgggagguggaaggcaccaucgagaugugcaucaaggacuuccugcugaacaacuacgaccuccccgccggggccgucugccgccuguaccacccaagcaugaucgacaccuaccccgacgccaaggcgaacaaguacggcgugcugcagcugggguccccggccacgaacgccauccggaaccccauggccaugcgcagccuccacgaguuacggcacgucgugaaucugcuccugcgcaagggcaagaucgaccagaacaccgaggugcacgucgaguacgcccgcgagcugaacgacgcgaacaagcggaaggccaucgccgacagacagcgggagcucgacaagcugcacaaaaaguaccacgacgacaucaucacccuguacaaggaggagaccgggaaggauaucaaccccacgcaggccgacauccucaaguuccaacugugggaggaacaggagcacgugugccuguacaccggccgccagaucggcaucuccaaguuccucgggcccgacccggaguucgacaucgagcacaccgugccccggagcgucggcggggacuccacccagaugaacaugacgcugugcgaccgccgguucaaccgcgacgugaagaaggcgaugcugccuagccagcuccccaauuaccaggagauccugccgcggaucgagaaguggaagaagaaguacgagaagcugacgaaggacaucgaccacugcaucacccacuccggcaugaccaaggaagccaaggacagcaucauccagaagcgccaccggcucacucuggagcacgacuacuggcgcaacaaauacagccgguucaccaugaccgaggugcccgagggguucucccgccggcagggcgccggcaucgggcuggucagcaaguacgccggccucuuccugaagucucuguuccacgaccccaccgaccgccggcgcagccacguguacgugguuaaggggaccacgaccgccgaguuccggaagauguggggacuccaguccgaauacgagaagaagucccgcgacaaccacgugcaccacugcguggacgcgaucaccaucgccugcaucggcaagaacgaguacaacaagauggccagcuucuaccacgacgaggaggccuucgagcguggggagugcgagaagccccacuucgacaagccguggcccaccuucacgcaggacguccucggccuggagaagcggcucaucguggugcacagcacccaggacaacaugcccaagcacgccaagaaguacguccguaccccgcgggggaaguucaucgcgaagggcgacugcgcccgcgggucccugcaccuggacaccuauuacggcgccaucaagcacaaggacgacacggagccccgguacgugcuccgccgggagcugagcuccuucgacagcgugaacgaccuggacaucaucgucgacgacgccguucgcgagaagaucaaggaggccgugaagggcaaauccgggaaggcguucaaggaggcccucgccaaugucuauaugaacaaggagaaggacauccggaucaagaaggugcgcugcuacgugcccagcgucaagcggcccaucgacauccgccaccagcgggacaugucccgcuucgacuacaagcggcaguuccacguggccaacgacggcaacuacaugauggcgaucuacgaggggguggucaagggcaagcugaagcgcgacuucgagcuggugaagaacaucgaggccgccagcuacuucaaggugucccaggacaacgagagcuucagcuccaucgucccggagaaguccagcaacggguucccccugaaggccgugcugaagaucggcacccacgugcugcucuacgagaacaccgccagcgagauugacuucuccgaccccgucgaucugacccggcgucuguacaagguggugggccucagcuccgcgaucaucaacaacugcagcuacgguuucaucacgcugagauuccaccaggaggcccgccaggccaagaaccugaagcucaccaagggcgucuucaagaacguugauaauuaccgcggggccaucauccuguaccacacgcagcugaaggcccucguggagggcuacgacuucgacaucaacauccugggggagaucaccuccaaacaguga

SEQ ID NO: 7538 - RNA, 3705 nt, Artificial Sequence
  Cas9 variant
augcccaacuucugguccaucuucacagaaaaccuccagaccuaccucaugaaaacccgcauacuaggccucgauacgggaacuaacagccucggaugggccgucgucgaccgagaugagaacaaccaauacacacccaucugccggggcgacuuaauauucacagaaggcgucaagcaagaaaaaggcaucgaguucucccucgcagccgaacgaacaagcuaccgagccucccgacggcacuauuuccgcagacgccuacggaagguggaaguucuaaagguacugguaaaacacaaacucugucccccguugucagacgaagcacucaacagguggcacacaaagaaggaauacccucuugaugaagacuucauacucuggcagcgcaccaaugaagcagacaacaagaaccccuaccacgaccgccacaucugccuucaccggaaacuaaaucugaaagacagccaaacggaucgauacacccucggccgcgcgcucuaccaccugacgcaacgccgaggguuccucagcaaucgccuagaccaaaacgaagaggcagaggaaacaggaaaggucaaaagcgccauaagugagcugagcaaagaaaugaaagaagcgggcugcgaguuccuaggcgacuacuucuaucuccuauaucguacugaaggcaaccgcguccggauacgcaguagauacacggaccgcgagaaacacuaccuccaagaguucaaggaaauaugccgaguacaggaacuggacgaagaccuugcaaaagcccucgagaaaaccaucuucuuccaaagaccccucaaaagccagaggcagggagucggcaaaugcacgauggaaaaaggucacucccgcugcgcggucagccacccguuauaugaagaauaucgccuucuuugcuaccugaacaauauacguauaaaaacacccuccgacgaccgacuccgcccacugaacgcggaagaacgagagaaaaucacgccccuauucuacaaagagaaaaacuucgauuucgagaaaaucgcaaagaaacuagccggcaaaacacccuucggguggauccgagacgccgaagacuggccauaccaauucaacuaccgcaugacacaagaagccccggccugcccgacgaccgcccaacugauaaaagucuucggagaagacuggaaagccgcccuagcugaaacuuacaccaugucggccaaacaagauggcacacucaaaacagaagacgagauuugcacagauaucuggaacguccuguacucauucucaagcaaagaaaagcucaaggaguucggucucaaaaagcuccagcucgacgaaguccaagccaaggccuucucggaaauacgacucacccgcgacuucgcuucccuaagccuaaaagcuauccguaaaauccuauucuuccucagaaccggcgaagacuacucuaaggcaauauuccuggccaauauaccaacaaucguaggcgaagaaauauggaacgacauugaacgccgauccaggcuccuauauaaagucgaccuggccuuacgaccccaggaagaacgcgacgcagaagaacaccggacaaucgcagagcguaucaaggcggccgucgcagccgaaguaccagacgcaccaauagaccuacuguaccacccaagcaugauagaagcguacccagacgcaaagcggaacgagagauucgacugcuaccaacuaggcucccccaaaacaaacgcaguacguaaccccauggccaugaggucacugcacauggugagaaaagucauaaaccaccuacuucguaaacacauuauagacgagaaaacagaaauacacaucgaauacgcacgagaacucaaugacgcaaauaagcgccaagcaaucgccgauuggcaacgugaacucagcaaacgccacaccgccuacgcacagaauauaagacagcuguacaaagcagaaaccggccucgucauagagcccaccaaggcagacauacucaaauaucaacuaugggaggagcaacaacacgucugcuuguacaccggcaagaaaauaggaaucgcagacuuccuaggagcaaacccaaaauucgauaucgagcacacuauaccccgcagccgcggcggcgacagcacacaagaaaaccucacccuaugcgaguccaaauucaaucgggacaucaaacgggauaaacuaccuacagaacuggcgaacuaugaagaaauacucgccagaauagagcauuggaagaaacaaugcuacgcacuaaaacugaaacgcgacggaauaaggacucauagcggucucgagaaaagcaucaaagacaguagaauccgcagacgccaccuggucggucucgaauacggcuaccuaaaagguaaauacgacagauucaccaugaaagaaguccccgaaggauucagccgacggcaaggcgcaggcauagggcugaucagcaaauacgcaggccuauuccugaaaucacuauucaaggacccuaaaaaccccaaccgguccaacgucuacguggucaaaggagcaaucaccgcggaguuccgaaaacuguggggacuacaacaagcggacgaagccaaaucacgagaaaaccacacccaccacugcaucgacgcguauacgauugcauguaucggacccugcgaauaugcagcacuggcagccuacuaccgauccgacgaagaguucaaguacggucgacgcagagaaaaaccccaguucgaaaagccauggccuaccuucacggaggaccucuuaaaacuccaagaggaacuccuuaucguacaccagacaaccgacaaacuaggaaaaagggaucgccgcaaagucaaaacaccccgaggcaaauuccugaccgggggagacagcgcaagggggcgccuacaucaagaaacguauuacggugcaauaaacuacgauggcaacauaaaauacgucguccggaagccauuagacucacucacagaaaaagaccuugacaaaauagucgacgagacaguaaugggcaucgugaaaggcgcaguagaagccaaaggaucccugaaagaagccuuagcagacgggauuuacaugaauaaagaaaaaggcauacuuaucaaacgaguacgcauauucuccgauguuucagaacccaucaaccucaagcaacugcgugacgugagcaccaaagaauacaaaagacauauacaccuccgcaaagacgaaaacuaucucuuugcgaucuaugaaggcaucgacaagaagaaaaacaagaaacaaaccgaaaccgccaccguagacuaucuugacgcagcaaaguucuacaaggacagcaagcgacgcgacaaagccaacucauuggucggcgauuacagcaagaaaaauaaacuaccacucaaauguauccugaagaaacgucaaaugguccuauucuaugaacacagcccggaagaaaucagauucaaagacaagaaagaccugucgcgccgccucuacauagucaccagcaucgcgaaggacggccgugugaaauuccuacaccaccaagcagccacagccaccgguauccaauccucccccagcccauucacaaacgacggcgaacaccaacccuacuaccgucuaagcgcaucaaacaucaaaguccuaguagccgggauagacuuugauaucaacauccugggagagauaacaccaaaacuauga

SEQ ID NO: 7539 - RNA, 3711 nt, Artificial Sequence; identical to SEQ ID NO: 1739
  Cas9 variant

SEQ ID NO: 7540 - RNA, 3717 nt, Artificial Sequence; identical to SEQ ID NO: 1740
  Cas9 variant

SEQ ID NO: 7541 - RNA, 3720 nt, Artificial Sequence; identical to SEQ ID NO: 1741
  Cas9 variant

SEQ ID NO: 7542 - RNA, 3738 nt, Artificial Sequence; identical to SEQ ID NO: 1742
  Cas9 variant

SEQ ID NO: 7543 - RNA, 3741 nt, Artificial Sequence
  Cas9 variant
augcgccugguguaccucgcacuggcccacaugaucaaguuccggggccacuuccuguacgagggggaccucaaggcggagaacaccgacguccaggcccuguucaaggacuucguggaggaguacgauaaaaccaucgaggagagccaccuguccgagaucacgguggacgcccucagcauccugaccgagaaggucuccaagagcucccgccucgagaaccucaucgcucacuaccccaccgagaagaagaacacccuguucggcaaccugaucgcccucagccuggggcugcaggcgaacuucaagacgaacuuccagcuuuccgaggacgccaagcugcaguucagcaaggacaccuacgaggaggacuuagaggggcuccugggcgaggugggcgacgaguacgccgaccucuucguguccgccaagaaccucuacgacgcgauccugcugagcggcauccuuaccguugacgacaacuccaccaaggccccgcugagcgccuccauggugaagcgguacaaggagcacaaggaggagcuggccgccuucaagcgcuucaucaaggagaagcuccccaagaaguacgaggagaucuucaaggacgacacgaagaacggguacgcgggcuacgugggggccgacaagaagcugcggaagcgcagcggcaagcuggccaccgaggaggaguucuacaaguacgucaaggggauccucaacaagguggagggcgccgacuacuuccuggacaagaucgaccgagaggacuuccugcgcaagcagcggaccuucgacaacggcuccauaccccaccagauccaccuccaggagaugcacgccauccugagacggcagggggagcacuaccccuuccugaaagagaaccaggacaagaucgagaagauccucaccuucaggaucccguacuacguggggccccuggcgcggaaggggagccgcuucgccugggcagaguacaaggccgacgagaagaucacgccauggaacuucgacgacauccuggacaaggagaaguccgccgagaaguucaucacucggaugacccucaacgaccuguaccugccggaggagaagguccucccgaagcacagcccccuguacgagaccuucacgguguacaacgagcugaccaaggugaaguacgucaacgagcagggcgaggcgaaguucuucgacaccaacaugaagcaggagauauucgaccacguguucaaggagaaccgcaaggugaccaaggacaagcuccugaacuaccugaacaaggaguucgaggaguuccggaucgugaaccucacgggccuggacaaggagaacaaggccuucaacgcgucccuggggaccuaccacgaccugcgcaagauccucgacaagagcuuccuggacgacaaggugaacgagaagaucaucgaggauaucauccagacccugacccucuucgaggaccgggagaugauccgccagcggcugcagaaguacagcgacaucuucacgacccagcagcugaaggagcucgagcgucgccacuacaccgggugggggcggcuguccuacaagcugaucaacggcauccgcaacaaggagaacaagaagaccauccucgacuaccugaucgacgacggguacgcgaaccggaacuucaugcagcugaucaacgacgacgcccucagcuucaaggaggagaucgcgcgcgcccagaucaucggcgacguggacgacaucgccaaugucgugcacgaucugcccggcucccccgccaucaagaaggggauacugcagagcgugaagaucgucgacgagcucgugaaggucaugggccacaacccgaccaacaucaucaucgagauggcgcgggagaaccagaccaccgacaaggggcgccggaacucccagcaaagacugaagcugcuccaggacucgcugaagaaccuggacaaccccgugaacaucaagaacguggagaaccagcagcuccagaacgaccggcuguuccuguacuacauccagaacggcaaggacauguacaccggggagacauuagacaucaacaaccugucccaguacgacaucgaccacaucaucccccaggccuucaucaaggacaacagccuggacaaccgcguccucacccgguccgacaagaaccgcggcaagagcgacgacgugcccuccaucgaggugguccacgagaugaagaguuucuggagcaagcugcugagcgugaagcucaucacccagcggaaguucgacaaucugaccaaggccgagcgcggcggacugacggagaacgacaaggccgguuucaucaagcggcagcucguggagacccgccagaucaccaagcacgucgcccaggugcuggacgcgcgguucaacgccaagcacgacgagaacaagaaggugauccgcgacgucaagaucaucacccugaaguccaaccucgugagccaguuccggaaggacuucaaguucuacaaggugcgcgagaucaacgacuaccaccacgcccacgacgccuaccucaacgcagucaucgggaccgcgcugcucaagaaguacccgaagcuggccuccgaauuuguguacggcgaguucaagaaguacgacgugaggaaguucaucgccaagagcgacaaggagaucgggaaggccacggccaaguacuucuucuacuccaaccugaugaacuucuucaagaaggaggucaaguucgcggacggcaccgugguggagcggcccgacauagagaccagcgaggacggcgagaucgccuggaacaagcagaccgacuucaagauuguccgcaagguguuaagcuacccccaggugaacaucguuaagaagacggaggugcagacccacgggcuggacagaggcaagccccgcggacuguucaacgccaauccgucccccaagcccaagcccgacagcuccgagaaccucgugggcaucaagcggaaccuggacccuaagaaguacggcggguaugccggcaucagcaacuccuacgcgguccuggugaaggccaucaucgagaaggggguuaagaagaaggagaccaugguccucgaguuccagggcaucagcauccuggaccgcaucaccuucgagaaagacaagcgggccuuccugcucgggaagggcuacaaggacauuaagaaaaucaucgagcugcccaaguacucccuguucgagcucaaggacggcagccgccggaugcuggccuccauccugagcacgaacaacaagcgcggagagauccauaagggaaacgaacuguuugugccacagaaguucaccacccuccuguaccacgccaagcggaucaacaacccgaucaacaaagaccacaucgaguacgugaagaagcaccgcgacgauuucaaagagcuccugaacuacguccuggaguucaacgagaaguaugugggagcgaccaagaacggcgagcggcucaaggaggccguggccgacuucgacuccaagagcaacgaggagaucugcacguccuuccugggggccgucaacagcaagaacgccggccuguucgagcucaccucccugggcagcgcguccgacuucgaguuccugggggugaagaucccgcgcuaccgggacuacacccccagcucucuccugaaggacagcauucugauccaccagagcaucaccggcuuauacgagacgcgcaucgaucuguccaagcugggggaggacuga

SEQ ID NO: 7544 - RNA, 3747 nt, Artificial Sequence
  Cas9 variant
augaagaagauccugggccucgaccuggggagcgccuccaucggcugggccgugaucaccgagaacgucgagaacgggaucaccaagugcgacauccugggcauggggagccgcaucauccccuacgagggcacggagggcaaagacuucaccaaggggaccggcgagucccggaacagccuccgcaccaaggcgaagaccgcccggaagggguacgaccgcuaucagcugcggcgcaaguaccugguugacacccucauuaagaaccagauguacccugacgaggccaccagaaaccugcccaagaugaagcugugggagcuccgcgacaaggccgugcacucccccgucagccugauggagcugggcagguuacuucuguggcucaaccagaagcgcggguacaaguccagccgguccgacgccaaccugggcaagaaggacaccgaguacguggcgacggucaagucgcgccacgagaagaugaaggagcuggacgugaccaucggccaguacuucuaccgggagcucuccgccaacgaguucuucaaggugaaggagaacauauucccccgcgaggccuacaucgaggaguucgacgccaucugcaagacccagcagaucgcgcacccgaugauccugcggagcgagcugaucgacaagauccgcaacgaagugaucuacuaccagcggccccucaagucccagaagggguuagucagcgugugcgaguucgagggcuucuggcgcaucgggaaggacggcaaagaguacuucgugggccccaaggucgcccccaaauccagcccacuguuccagcucgccaagaugugggagaacaucaacaacaucaagaucgggucccggaccggcgaggaccuaaagcugacgaccgagcagaagugggccaucuuccaacaccucgacaacaacgagaagcugacccccaccgaucugcucaaaauccugaaccugaagaaggaaaacugcuacgugaacaagcagauggggaagggccucaacgggaacaucacuaagcacgccauccugcagugccugggcggcagcgacaaguacgagaaccuccugaagcuggagcucaagaugguggauggggacaaggaaggcuaucuauaugaccgcaagaccggggagguccugaacuccaagaugaucaaguucaucgaccccaugguggagcaggagcccuucuaccagcucuggcacaucaucuacagcauccacgaccaggaggagugcucgcgggugcugcaggcgaaguucgacaucgagcagccgaucgccgacaagcuggccgccaucgacuucuccaagcacgccuucggcagcaaguccgcgaaggucauccgcaagauccuccccuaccugauggacggggacggcuacagcgaagccauguccuacgccggcuacgaccacagcaacucccagaccaaggaggagaaccugcagcgcaagcuccuggaccugcugaagcccauccccaagaacagccuccgacagccgaucguggagaagauccugaaccagauggugaacgucgugaacgccaucaucgagaaauacgggaaccccgacgagauccgcguggagcuggcccgcgagcucaagcaguccaaggaggagcgcaaugacgcggacaaggccaugagcaagcgccagcgcgagaacgacgcaaucaccaagcggcuggaggaguucggccugcgcgccacgcggaacaacaucaucaaguggcgccucuacgaggagaucgacaaccaggagaagaagcugaacgccaugugcgucuacugcgggcagcccaucucccugaccgaggcgcuccgggguaacgacguggacaucgagcacauaaucccgaaaagcaagcuguucgacgacucgcagagcaacaagacccuggcccaccgccacugcaacaagaacaagaacgaccucaccgccuacgacuuuaugaaggggaagccggaggccgucuucaacgaguacguggagcgggugaaccuucuguacgacaaccacaucauccgcaaggcgaagcgggacaagcuccugaugacggaguccaagaucccggacaacuucaucgaccgccagcugcgggagagccaguacaucgccaagaaggcccgcgagauucuccagaccaucugccacgacgucugguccaccagcggcaccgugacggccgagcugcggcaccuguggggcugggacgacgugaccaugaaccuccagauggccaaguaccgcgagcuggggcugacccaccaagucgagugggaguccgagcacggcaagaacaagcacgagaaggaggugaucacggacuggacgaagcgcgacgaccaccggcaccacgcgguggacgcccucaccaucgccugcaccaagcagggguucauccagagauucaacacccugagcgccgccaagacgcgggaggacaugauguucgacaucgagcagcgcagccacgaguucaaggagaagcggucccugcucgagaaguacaucaucagcgagcagccccugaaggucgacgagguggagaaggcgguguccaacauccugaucagcuucaaguccggcaagaaggucgccguguggggcacccggaagaucgggaagcggggcaguaagaaggugauccagaaaaagaucaucgucccucgcgggucccucagcgaggaguccguguacggcaagaucaagaagcaggaagagaaggacuacaaguaccuguucgagaacccgcagcugaucuucaaccccaccaucaaggccaaaguggaggagcggcuccugauguucgauggggacgugaagaaggcaaucaccagccugaagaagauccccaucuaccucgacaacaacaaaaccguggugcuggagaaggccaucugucugaaggacgaguucgucaucaaguacuccguggacaucaacuucaacaagguggacaaggucguggaccccaagaucaaggagauccugcagaaccgccugaagaaguucggcggcaaggagaaggaggcguucaaggacgugcagcuggaggacaagaugauuaucaagugguacgaggacgagggguuggagcggccgaucaagagcguccgcugcuucacgggccuguccgccguggugcccgucaagaaggacgagaacgggaacgacaucggcuucgucaagcccgggaacaaccaccacaucgccaucuacaccgauaccgaggagaacaagcagcagcacgugugcaccuucuggcacgccgucgagagaaagaaguacgacauccccgugaucaucaagaacacgaacgaggugugggacaagauccagagccagcccgacggaaccuaccccgacuccuuccuggagaugcugcccccucccaaccucaaccugcucgucaacaugcagcagaacgagauguucauccugggcaccaccacggaggacaucaagcuggcuaucgacaagcgcgacuacaagaucaucggggacaagcucuaccggcugcagaagaugagcaucaagcccuccagcggucagaucgacaucguguuccgccaccaccuggagacccaacucaucgacgacgagaacagcaagaaauccaagcgguucuacaacgugcagagccugggggcccuguucgcccucaaccccuuuaagguccgcaucgacaaucugggcaaccuggugaaagagaaguga

SEQ ID NO: 7545 - RNA, 3762 nt, Artificial Sequence
  Cas9 variant
augaaggcccgcggcaacuuccugcaccaggacacccccgggcucaccgccgcgaacgccaacaugggcgacgccguggagaagcugugcgucgcccuggaggacuggugcacgcugcggaaccuggaguguaacauccgaaagaaccagaaaaacauccagaaucugcucgaagggaagaccguggaggugagcgccgagaaugcgcugaaagaguccuucgacagcucccgggccagccgcaaggacaaagcgaccaucuuguccaccuggaucgccauccagccgggcgaguaccucgacgcgaagcaggccaaggacgccagcaaagagaucgccaacguccuguucggucugcagggcaauaugaaaaagaucuucaucgaguucgaggaggaccagaagauccggcuugacaacgacgagcaggucgaggccuucuacucccucugccccgacgacggcguggcccuguuugagagcuuccaguccaucuacagugccuacaucuugauggggauucucaagaacgcgaacggaggguccaucagcucuugcaagguggcugccuacgaccaauacaaagaggauuuaaagcuccugaaagaccuugugcgcgaguucgcgagcgagaaguacgaugaguucuuccgaggcgacaucuucgacucgagcaagggguuccgggcccggaacuacaaccccgccacggcaaagggcuauaccaaguacaacuccgugcgcggcgcuagcuacgacgacuucaagaaggagguugaaaagaucuucaaggggacgguggcggaggaagacaucagguacguggauaugaugcaacguuucgcugagggcaccuuccuccggcgccucaagacaagcgacaacgguagcauccccuaccagcugcaucucgaggagauggacgccaucgucgagaaucagaagcaguucuacccguuucuggaaagcgagaaggagaaacuugagucccucguaaccuuccgcaucagcuacuacguuggcccccugacccagaagaacgcccgcuuagauaaccacaacaacgcccgguucgcguggucccagcgcaaggagggcaaggaacacgcccgggucuacccauggaauugggaggaagugaucgaccgcaagcagucggccgccaaguucauggagcggcucaccgggacgugcaccuacauccucgacgagcccgugcuaccgcgcugcucccucuuguacgaggaguacugucuacucaaugagcucaacggcagcaaguggcgugauaugggcggggacuggcaccgguucgacuacgagacccgcauggagaucaucgagaaccuguucaagaagaagaaggguuccgucaaguacgcggcuguggaagauuggcucaagugcgagaagcauaagagcugcgccgaggugaagggcggccagggggagaccggcuucgagucgaagcucucuuccuacgucuucuucaaggaggugcuacacguggaugagaucgacgaggccgacaucccaaugaucgaggagcucaucugguggaacacccucuucgaggaccgauccauccugaaggaauccauagaggacaaguacggggacaggcucacggaugaccagaucaaggccaucugcaagaaaagguucaccggcuggggucgccugagcaaggagcugcucugcggcaucaagacccacacggacaacggcccuuacucgauaauggacgugcugcgggaggggaaccccaacaacaacgcgcgcagcgaaaccaugguuuucauggagauccuaagggacgacaaauucggcuucgacaagcugauugaggaggagaacaugcgcagggucuccgagguggacaacuucgacgugaacgaccuuccggggagccccgccguccgccggaccgugaaccaggccaagcgcauaguggacgaaaucgucggcauugccgguugcgagccgcagaacaucuucaucgaggugacccgggacgaggacggccgcaacaaaggccgucgcacgaagcggcgcuacgacaauaucaagaacgcaauagcagcgcuuaagaaggagcagaaagaguauuucaauaaggacguguccgacagccugaacaaaaccaaccccagcgacuuagacaacgagcgcuuagcccuguacuucaugcagaacgggaagugcauguacugcggcaaagaccucgacaucaagcagcuggacaaguaccaagucgaccacauccugccgcagucauacgugaaggacgacagcuucgagaacaaggcacucgugcacauggaggauaaccaacggaaauccgccagcaugcuguuggaugauuccaucauccgcaagaugaagcccuauugggaggcgcuccgggccgccggccugaucggugaaaagaaguucaagaacuuaacucguguccgggucagcgacaaggaacucggaggguucaucgcccgccagaugguggagaccagucagagcaugaaguuaacgaguuuaguccucgagaagaccuaccccaacaccaacgugcgacccgugaaggcgggcuucagcagcgaccugcgcaagcgucuagaccucaucaagugccgcgagaucaacgacuaccaccacgcccacgacgccuaucuggccugcgagaucgggcaauucaucacuaugcggcacaacaagcuguacgagaacccgauuagcuacucacacgcugucaaggacuucaucgcgaagagagccaaguaugccaacgaucauggcacccccaugagcaccuacgggaugcccggcucgucguccuucgugaucucuagcuuccuaaccagcggcuucgacgaggagacuggggagaucuucaaggacgcguggagcgcggagguggcggccguaagaauccgagaguccuuaaaccggaaggacugcuacauaagccgcaugcccgaggagacguccggcgccuucuggaaggagacacugaucagcccgagggaccccucccucgggaaaaaccugagccugcccaucaagaaggggcuggacccccgcaaguacggcggcuacaacgagcagaaguucgccuacuuuuucguguacgaggccgugaagaucaagaaaaagggcgaagucaaggaauauguguucgcggccgugccgguccagguggccgccaucguggcgcgggaccccaacgcccugaccggguucgccaagaaggacgcggaggcccgcaagaucaaguuccugcggaucauucgcgagaaagucuacaaguaccagcuaaucgaggugaacggcgagcgccuguacaucacugggcugaaguccguacggaacgcgcgccagaucgcucucagccaggacaugaccacggucuuccugaaggccauuaacgacaaagacguggccgaggacgagcugaagucgcuguucgaggagaucgugcaacgguaccgccucugcgcgaaccggcuuggaaaccaguugaagaucuucagccuauccgacagcuucaacagugccaacagcgaaagcaagaagcgagcccuggucagccucguggccaucaucgacgcgaagacaaacaagaucgacuuguccgggaucggcagcggcaaggccguggggaacaugcggcugagcuucuccaaggagaugagcaacagcaagaaccacuucgcguucauugaccagagcguuaccggcauguucgagcguaaaaccuaucucuga

SEQ ID NO: 7546 - RNA, 3777 nt, Artificial Sequence; identical to SEQ ID NO: 1746
  Cas9 variant

SEQ ID NO: 7547 - RNA, 3780 nt, Artificial Sequence; identical to SEQ ID NO: 1747
  Cas9 variant

SEQ ID NO: 7548 - RNA, 3792 nt, Artificial Sequence
  Cas9 variant
augcacaagaacaaccccgacauccgcgagcuguuccuggccauccaccacauccugaaguaccggggccacuuccuguucgccgggcagcaguuuaagggcagcgagaucaaggacaacauccgcgagcuccugcaguacaacucccugaacaucaagaucgacaucaccgacgagcucaucaacaacaucgcggagauccugcugaagaagaagaacagcaccgacaagaucaucgaguuuaagaagcuguucgccgacgagaagcaguuaaucgaggcccugcggcucgcccuggggaacaagacgcagcuggccaagcuguucgauaucgaggcguacaaggagcuggacaucuccauuaagaccaucagcuucaaggagaagaucuacgaggacgugcgcuccaacuacgaagagauccugggcgaguacaucaucguccucgacaccgccaagcugaucuacgacgccaucauccugagcgagaucaagaucaagaacaugaccaucuccgagagcaaagugauuuccuacgagaagcacgggaaggaccucaaacagcugaagcaguugaucaaggaggacagcaagcucuccaagaaggagaagcggcagcuguucgagaacaucuucgugaaggaggacgagaaggaggccaacuacgucaacuacaucggcaagaacaacgugggaagcuccaagagcuccugcagcuacgaggacuucaagaagucccugaucaaggagcucaaauacugcgaggagagcaagcugaagcaggacauccuggcggagcuagagcuggagacguuccugccgcgccagcggaccaaggacaacucggugauccccuaccagauccacaaggaggagcucgagaagauccugaacaacgccguccaguaccaccccuuccugaacaacaccgacgaguacgggaucagcaucaaggagaagaucauccagcuccuggaguuucgcauccccuacuacgugggcagccugaacaccucccacaagguggggaacggcggguucagcugguccguccggaauaagggcuacgagcgcacggccgugaccccguggaacuucaacaaggugaucaacaaggaggagagcgccaagaacuucaucgaaaaccucaccaaccagugcaccuaccugcuguacgaggacguccuccccaagcacucccugcuguacagcgaguuuacgcuccugaacgagcucaauucaaucaacuacggcgggaagcggcugaccguggagcaccgcaaccugaucaucgagcgguucuucaaacagagcgcucccaaggcgaccggcaaggagcugaagaaguuucugauguccgagggggugaucgacggcaaggacgagcucagcggcuucgacaucuccaucaaaaacgaccucaagagcuaccgcgacuucaagaaaauccugggggagaaguucgacuccgagaaggucgagaaaaugauccgguggaucacccucuucggcgagagcaagcagcugcugguggacaagaucaccaaggaguacggggacaucuacuccagcgaggagaucaagaagaucuccggccuuaccuacaaggacugggggcgccugagcgaaaagcugcucaccgagaucguguccagccagcuguacgacgaaagcacgggagagugcuucaacaucaucaacgcaaugcggaacaacacgcuccucuucaucgagcugcugggcaccaacuaugacuacuucgagaagaucaacacauacaacggaaaacuccgcaaggagaucaccgagaucacgccccacauccuggacgacuuguacgucuccccggccgugaagcggagcaucuggcaggucgugcgcaucguggaggagcucaaaaaggucaucggcagcgagcccaagcggaucuucgucgagaccacccgcagcaacaaggagaagaagggggacgacggacgcaaggacucccggaagaaagcccugcuggagcuauacaagaaaaucaaaaccucugacaucgccgagcuggagaaggcucuggggcacacgguggacuucgacaagaagaagcaggaccucaccgacaucgacaacaacaagcugaaggcccgcaagcuguaccucuacuacacccagcugggccggugccuguacaccggcaaggccaucgaccucaacaacuuauucggguccaacagcgaguacgacaucgaccacaucuacccccaguccaagacgaaggacggcagcuggaacaaccugguccuagugaacaagaccgagaacuccaagaaguccaacgggcugaucucugagagcauccagcgcaagaacaagcacuucuggcgguuccugaaggccaagaaccucaucuccgaggagaaguacaagcgccugacccggaccgaggacuucacggacggcgaacugagcggguucaucgcccgccagcucaucgagaccucccagagcgugaaggucgugagcaagauucugcagaaccugaaccccaccaccgagcucugcuucuccaaggcggagaacgugagcgacuuccggcaggaguucgguaaaaucaaggucggcaagcgcaagaaccuaaccgaggaggagcagaagaaggcaaaggaggggcagcugaucaaggugcgggaucucaacgaccugcaccacgccaaggacgcuuaccugaacaucguggucggcaacguguaccacaucaaauucacgcgcaacccgaagaacuucauccggaagaacuucaagaacagggaguacacccucaacacccuguucuacuccgacaagguggagcggaacggagaggucgccugggagaagggcaagaccgaggagaucgugagcuccgugaugugcaacaaccugaucaacgucacgcgccggacaagcgagcagaaaggcgcgcucuacgaggccaccaucuacaaggccaacgccgcgaaggagggguccuacuaccccgugaagaccaacaacaagaaccugaagaacgugacgcgcuacggcggguucaccagcaucaagaucgccuacuacuccaucuucaaguacgacauccggaauaaagacaaggucaaggagaacaucaagauuauccccauccccaucuacauuagccagaacaucaagaccgaccuggaccucaucaacuucgccgagaagcagauuaagcugaagaagggcgagaacaucgagaaccugcagcucaucuacaaaaagcugaacaucggggcccuggugaaaaucgaccacuacccguacuacaucggcggcaagaccgacgacaacuucuacguugacggggccguccaggugcuccuguccagcgacaucgagcgcuaccugaaggaaguggugaaguucgugaacuuccagcgcgagaacaaggaggcgaagguguccaaggagcacaucagccucgaggagaacaucaagcuguacaacacgcuggucugcaagauggccaccaagaucuucacccacaagaagaacaacaaauacaacgaccucacucaggacaaggccaagaacacguucaacaagcugagccuggaggagcagugcaaagugcuccuggagauccugaaccuccugaccaacaagaagaccaccuucgaccugagccucaucaacgagaagacgucccgggugaagugcggcuucaaccugcugaaccagaagcaguucagcaucaucgagcagucggucaccgggcucuacgagaaggagaucaagaucaucgaggacuga

SEQ ID NO: 7549 - RNA, 3795 nt, Artificial Sequence
  Cas9 variant
augaagaacguccugggccucgauuuaggaaccaacagcaucggaugggcccugauugaggucgacgagaacaaccuccccauccgcaucaucgcgauggggucccggaucaucccucucagcaccuccgacaaggaggaguuccagcgcggccugagcaucacgaagaaccagucccggaccgugagccgcacccagcggaagggguacgaccgcaagcagcucaagaaguccgaccugaagaaaaucuugaacaaguacaacaucuuccccagcgaggagcuccugcgcuugccaaugcucgaccuguggaagcugcgcuccgacucugcgaaccccgacgagaacaucucugccgagcagcucgggcggauccuguacaugcugaaccagaagcgcggcuacaaaagcgcccgguccgaggccaacgcagacaaaaaggacagcgacuacgugcaggcggucaaggggcgcuacgaucagcucaaggaccggaagcagaccaucggccaguacuucuacgacgagcuguacaacgccaacgccaacaacuccuacuuccgcaucaaggaggagguguacccgcgggaggccuacaucgaggaguuugacacgaucaucagcgcacagagggaaaagcacgacuuccugaccgaugaggugguccaccagcuccggaacgagaucaucuacuuccagcgcaagcugaaaagccagaagggacuggugagcaucugcgaguucgagggcuucgagaaaaccguguucgacaaggagaagaacaagaacaagguuguguucguggggcccaaggucgcccccaagaccucuccccucuuccagcugugccggaucugggagguggugaacacgaucacucugaagaucaagaacccggagggcuccaaguacaaguggggcgagaagauccccgacaucaaggagaaggagauccucgccgacuaccuguucaagaacgagagccuguccuucagcaagcuccuggaaauccuggagcucaaaaaggagaacgucuacgugaacaagcaaauccugaaggggaucaagggcaacgagaccuacucggcccugcacucgauccucggggacaacgaacugcugaacuucgacgugucuaucaugaccagcaaccagacagcccuccuggucgaccgcaagaccggcgagauccuagaggagcgggcgggccucgagcuggacgccucccuggagaaggagccgcucuaccaacuguggcacacaaucuacucucugaaggaccucgacgagugcaagaacgcucugaucaagcgcuucgacuucgaugacgagaccgcggagaagcugucccgcaucgacuucaacaagcaggccuucggcaacaagagcaacaaguccaugcggaagauccuccccuuccucauggagggcuacgacuacagccaguccagcucccuggcgggguacaaccacagcaacucccucacgaagaacgagcgcgaacagcagaucacccucgaccggcuggagcugcucccgaagaacagccugcgccagcccaucguggaaaagauccugaaccagaugaucaacguggucaacgccauccucgacgaguacggcaagcccuccgagauccggguggagcuagcgcgcgaacugaagcagagcaaggacgagagaaacgagaccgaccugcagaacucgaagaacaagaaacugaacgacgagaucgggaagcgccuggaggagcucggccugcccgugaccaagcgguacauccagaaguacaaguucaucuuccccagucugagcaagaaucucaaggaggccaaggucaacaaucagugcaucuacugcggugagacguuuaaccugaccgaggcccugucgggggaugcguacgacguggaccacaucguccccaaggcccuccuguucgacgacagccagaccaacaaggugcugguucaccgcaagugcaacagcacuaagacgaaccagaccgccuacgacuauauagccaccaagggcgacgagcaccucaagcuguacagcgagcggcuggacgacugguucgagcgcgggaucaucuccuacagcaagaugcagcggcucaaagucucccacaaggaguaccuggagcgcaaaaagcugggcaaggagaccgagacggacaagaagcucugggagaacuucaucgaccggcagcugcgcgacacccaguacaucagccggaagucccgcgagauucugcagaagaucugcaaugacgugaagaccaccgagggcggggugacggccaagcuccggaaucuguggggcugggacgacguccugaugaaccuccaaaugcccaaguacaaggagcuggggcagaccaucaccaaggaauggaccagcgagcacggcaagcgcaagcaccagaaggaagagaucgacaacuggacgaagcgcgacgaccaccggcaccacgcgaucgaugcccuggugaucgccugcaccaagcagggguucauccagcgcaucaacacucuaaacuccagcgacaccaaggaccuuaugaucaaggagguggaggaggccaagauagaguucaacgagaagaccacgcugcuggagaaguaccugaagacccagaagcccuucuccacccaagaagucaugaaggaggcggacaagauccuggugagcuucaaggccggcaagaagguggcgaccaucacgaaguucaaggccaccgggaagaacaaggagaccggcgugaucgugccgcgaggcgcccuccacgagcaguccguguacgggaagaucaagguaaucgagaaggacaagccccugaaguaccugcucgagaacagcgacaagaucgugaacccccgcaucaagaaccugaucgagauuaagcugagcgagaacaagaacgaccccaagaaggcucuccuggcccugaagaagaucccgaucuuccucgacgaggagcaguccaucacccuggagaaagccagcugcuacaacgacgccacggugcugaaguacaaacuccagaaccugaaggccgcgcaagucgacgacaucguggacgagaaggugaagaagaucgucagagagaggcugucccaauucggcaacaaggagaaggaagccuucaaggauacccucugguucaacgaggagaagaagauccccaucauuaccgugcggcuguucgcccgcccugacgccaacaaccugcagaccaucaagaaagacgagaaugggaacggcaucggauucguggucacggggaacaaccaccacaucgccauauacgaggacaaggacaacaagcccgugcagcacagcugcaccuucuggcacgcgguggagcggaagaaguacaauaucccggcagucauccgcgacaguagcgagguguggaacgaccuccugcggaaggagcuacccgaguccuuccucaacaagcugcccgccgacaaccugaaucucaaauucagcaugcagcaaaacgagauguucaucuuaggccugucacaggacgaguucgugaaggccaucgcgaacaacgacaagucccuccugaguaagcaccuauaucucgucuggagcaucuccgagaacaauuacugguuccgccaccaccuggagaccaagaacagcgaccugaagaagaccgacggggugaaggagucaaagcggcucuacaacauccgcagccugggaucccuguucagccucaacccgaucaagguucgacugaacuaccugggggagaucaccaagaucggcgaguga

SEQ ID NO: 7550 - RNA, 3801 nt, Artificial Sequence
  Cas9 variant
auggccaaguacauccugggccucgaccuggggaccaauagcaucggcugggcccugaucgagguggacgagaacaacauacccauccgcaucaucgucauggggucccggaucaucccgcucagcuccaacgaccgcgaggaguuucagcggggccugucuaucaccaagaaccagaaccguacgaucucccggacccagcgcaaagguuacgaucggaagcaacugaagcgcaacgaccugaacaaggugcugaacaaguacaauaucuuccccagcaagaugcugcuuaaccuacccaugcuggaccucuggaagcugagauccgacagcgcgaauaguaacaaggacaucagcgcggagcagcugggcagaauccucuauaugcugaaccagaagcggggcuacaaguccgugcgcagcgaggccaacuccgacaagaaagacaccgacuauguucaggccgugaagggacgguacgcgcagcuuaaggaccgcaaccagaccaucggccaguacuucuacgaggagcucuacaacgcgaacgugaacaauagcuacuucaagaucaaggaggaggucuacccccgggaggcuuacaucgaggaguucgacacgaucaucaacucccagaagaccaagcacgaguuccugaccgaccaauucgugcaccagcugcgcaacgaaaucaucuacuuccagcggaagcucaaaagccagaaggggcuaaucuccaucugcgaguucgagggcuucgagaagaccguguucgacaaggagaagaauaagcacaagaucgucuucguggggccgaagguggcgccccguagcgcgccccuuuuccagcucugcagagucugggaggugaucaacacgauauccaucaaggugaagaaccccgagggcagcaaguacaaguggggcgaacgcaucccgagcaucaaggagaaggagauucuggccgacuaccuguucaagaacgagguccucucauucaccaagcugcuggagauccucgguuugaacaagaacgacguguacgugaacaagcagauccugaagggcaucaaggggaacgagaccuacgccacccucuacaacauccugggggagaacgaguucuuaaacuucgacgucagcaucauccccuccaaccacacuagcaugcuaguggacaagaagaccggcgagaucuuggaggagcgggccgggcuggagcucgacgugucccuggagaagcagccguucuaccagcuguggcacaccaucuacagcuuaaaggaccuggacgagugcaaaaacgcccugaucaaacgcuucgacuucgacgacgagaccgccgagaaccucucccgcaucgacuucaacaaacaggccuucggcaacaaauccaacaaguccaugcggaagauccugccguuccugauggaagguuacgacuacagccaguccugcagccucgccggcuacaaccacuccaacagccugaccaaggacgagcgcgagcagcaagucacccuugaccggcuggagcuccugccgaagaacucccuacgccagcccaucguggagaagauccucaaccagaugaucaaccuugugaacgccauucuggaccaguacggggagcugagcgagauccgggucgagcuggcccgcgagcugaagcaguccaaggacgagcggaacgacgcugaccuccaaaacaccaagaauaagaaacugaacgacgagaucggcaagcgccuggcggagcucggccugcccaucaccaagcgguacauccagaaguacaaguucaucuuccccucguuauccaagaaccucaaggacgcccacgugaacaaccagugcaucuacugcggggaaacguucaaccugagcgaggcccugagcggcgacgcauacgacgucgaccacaucgugccgaaagcccuccuguucgacgacucccagaccaacaaggugcugguccaccgcaagugcaacagcaccaagaccaaccagacggcguacgacuacaucuccaccaagggugacgagcagguacggaucuacuucgagcgcguggacgacugguuuaagagcggcauuaucuccuacucgaagaugcagcggcucaaggugagucacaaggaguaccuggagcgcaagaagaucgggaaggaaaccgagaccgacaagaagcugugggagaacuucaucgacagacaacuccgcgacacgcaauacaucagccggaagucccgcgagauccugcaaaaggugugcaacaacgucacuaccaccgagggcggcgucaccgccaagcugcggaaccucugggggugggacgacgugcugaugaaccugcagaugcccaaguaccgcgagcucggccagaccgugaucaaggaguggaccagcgagcacgggaagcgcaagcaucagaaggaggaggucgagaacuggaccaagcgggacgaccaccgccaccacgccaucgacgccuuggugaucgccugcacgaagcaggguuucauccaacggaucaacacccuaaacuccagcgacaccaaggaucucaugcugaaggagguggaggaggcgaaggucaaguucuccgagaagaccacccugcucgagaaguaccugcgcacgcaggagcccuucucaacccaggaggugaugcgggaggccgacaaggugcugguuucauucaaggcuggcaagaaaguugccaccaucacaaaguucaaggcgaucgggaagaacaaagacagcggcguuaucgucccccgcggggcccuccacgagcaguccguguacggcaagauuaaggugaucgagaaggacaagccgcugaaguaccuguucgagaacagcgaccgcaucgucgaccccaaggugaagaagcucguggagguccgccugagcgagaacgagaacaacuccaagacggccauaagcacucuaaagaaggcccccaucuuccucaacgaggagaaaacagaaguacuggagaaggccucaugcuacaacgacgcgaccgugcugaaguacaagcuccaaagcaucaaggccucccaagccgacgacaucguggacgagcgggugaaguuccugguaaaggagcgccuggcccaguucggcaacaaggagaaggaggccuucaaggacauucucugguucaacgaggagaagcagauccccauaaucagcguccggcuguucgcgcgcccggacgccaacaaccuccaggugaucaagaaggacgagaacggcaaguccaucggcuucgugcugacggggaacaaccaucacaucgccaucuacgaggauaaggacaacaagcugauccagcacagcugcaccuucuggcacgccgucgagcggaagaaguacaacauccccguggugaucaagaacuccagcgacgucuggucccagcugcucgacaagcagcugcccgagagccugcucaacaagcugcccaccgacaagcugaaccucaaauucuccaugcagcaaaacgagauguucauccugggccugucucagaaggaguuugacgaggccauaaagaacaaccacaagucuuuccucagcaaguaccuguacuugguaugguccaucagcaacaacgacuacuauuuccgccaccaccucgagaccaagaacacggagcugaagaauauaucgaccgcgaaggagagcaagcgguacuuccgcuucaagagcgugggggcccuggucggcaccaacccgaucaaaauccggcucaaucaccugggggagaucaacaaggugggcgaguacuga

SEQ ID NO: 7551 - RNA, 3807 nt, Artificial Sequence
  Cas9 variant
augaccaagaacauccugggccucgaccuggggaccaacagcaucggcugggcccugaucgagguggacgagaacaacacgcccauccgcaucaucgcgaugggaucccggaucaucccgcucucgaccuccgacaaggaggaguuccagcgcggccugucuaucaccaagaaccagucccggacagugagccgcacgcagcggaagggguacgaccgcaagcagcugaagaaguccgaccuuaagaagauccuaaacaaguacaacaucuuccccagcgaggagcugcucaagcugcccaugcuggaccucuggaagcugcgguccgacagcgcgaacccuaacgagaacaucuccgccgagcagcugggccgcauccucuacaugcugaaccagaagcggggcuacaaauccgcccgcuccgaggccaacgccgacaagaaggacaccgacuacgugcaggcggugaaggggcgguacgcccagcugaaagagcgcaaccagaccaucggccaguacuucuacgaggagcucuacaacgccaacaccaacaacagcuacuuccggaucaaggaggaggucuacccgcgcgaggccuacacggaagaguucgacaccaucaucaacgcgcagaagaacaagcacgauuuccugacugacgagguggugcaccagcugcggaacgagaucaucuacuuccagcgcaagcucaagucccagaaggggcuggucagcaucugcgaguucgagggcuucgagaagaccguguucgacaaggagaagaacaaggauaagguggucuucguggggcccaagguggcccccaagacgagccccuuguuccagcucugccggaucugggaggucgugaacaccaucucccugaagaucaagaacccggagggcuccaaguacaaguggggcgagaagauccccaaccugaaggagaagcagauccucgccgacuaccuguucaagaacgacagccugagcuucaccaagcuccuggagauccuggaccucaacaagaacgacguguacgucaacaagcagauccugaaggggaucaagggcaaugagaccuucuccacgcugcacaccgugcucggcgacaacgagcugcugaacuucgacgugagcaucauccccuccaaccacaccagcaugcucgucgacaagaagaccggcgagauccuggaggagcgcgccggccuggagcucgacgccucccuggagaaggagccccucuaccagcucuggcacacgaucuacagccugaaggaccuagacgagugcaagaacgcacucaucaagcgguucggguucgacgacgagaccgccgagaagcucucccacaucgacuucaacaagcaagccuucggcaacaagagcaacaaguccaugcgcaagauccugcccuuccugauggagggguacgacuacagccagaguugcagccucgccggcuacaaccacuccaacagccuaaccaaggacgagcgggagcagcagaucacccuggaccgucucgagcugcuguccaagaacagccuccgccagcccaucguggagaagauccugaaccaaaugaucaacguggucaacgccauccuggagcaguacgggaagcucuccgagauccggguggagcuggcgcgcgagcugaagcagagcaaggacgagaggaacgacgccgaccuccagaacuccaagaacaagaagcugaacgaggagauaggcaagcgccuggccgaacucggccugcccgugacgaagcgguacauccagaaguacaaguucaucuuucccagccugagcaagaaccucaaggacgcccacgucaacaaccagugcaucuacugcggggagaccuucaaccugaccgaggcccuguccggcgacgcguucgacguggaccacaucgucccgaaggcccuccuguucgacgacagccagaccaacaaggugcuggugcaccgcaagugcaacuccacgaagacuaaccagaccgccuacgauuacaucgggaccaagggagaggagcagguccggguguacagcgagcgcaucgacgauugguucaaacgggggaucaucuccuacagcaagaugcagcgccucaaggugucccacaaggaguaccuggaacggaagaagcugggcaaggagacggagaccgacaagaagcucugggagaacuucaucgaccgccagcugcgagacacccaguacaucagccgcaaggcccgggagauccugcagaaggucugcaacaacgugacgacgaccgagggugggguaaccgccaagcuccgcaaccuguggggcugggacgacguccugaugaauuugcagaugcccaaguacaaggagcuggggcagaccgugaucaaggaguggaccagcgagcacggcaagcggaagcaccagaaggaggagaucgagaacuggacgaagcgcgacgaccaccggcaccacgcgaucgacgcccugguggucgccugcaccaagcagggguucauccagcgcaucaacacccucaacagcuccgacacaaaggaccugaugcagcgcgagaucaaggaagccaagaagcuguuaggcgagaacuacaacgagaaggaguucgagaacgacaacgaguucgugaagaaccacaaggagcgacugagccagcuggacgacuaccuccgccugcagaagccggugaaguucgacacgaaguacgucgagcaggaggcggacaaggugcugguguccuucaaggccggcaagaagguggcgaccaucaccaaguucaaggccaccgggaagaacaaggacacgggcgugaucgugccccgcggggcccuccacgaggcgggccuguacgguauccggaccaucuacagcaagggcgggaucgccgagaagcacaucaucaaaaaguacaaggucgggguguccgcccaggaccacaucuucaccggcaaggaaaccuacagcgugaagaaggacaagaacgggaacgaaaaggucgacgacaagaucaagaucgugcuggacuccaucguggacaacaaggucaaggagguggugcucaaccggcugaaccgcggcuucaacaaugaggaggacuaccggaucgacgucaagaaggcccugaacaacuucaagaaccucgacgaggacccgcugugguacaacgagagcaagggcaucaagauccugagcaucaagcucaagacggggcugaaggacuccguggugccccugcgccucaacgagaagaacgaggucaucacccucgugaagaccggcaacaaccaccacaucgccaucuacgaggacaacgacgggaagcugauccaguacagcugcaccuucuggcacgcgguggagcguaagaaguacaacauccccacggucauuaagaacucuagcgagguguggaaccaggugcucgacaagaagcugcccgagucguuccugaaccgccucccggccgacaagcugaaccugaaguucagcaugcagcagaacgagauguucauccucggccuucuggaggaggaguucgacaaggccaucaaggacaacgacaagucccuccugagcaaguaccuguaccucgucugguccaucgccgagggggacuacugguuccggcaccaccuggagaccaagaacaccgagcugaagaagaccaacggcgccaaggagaguaagcgcuacuuccggcucuccacgaagggccugauugaccugaaccccgugaagguccgccuaaaccaccugggggagaucaccaagaucggcgaguacuga

SEQ ID NO: 7552 - RNA, 3810 nt, Artificial Sequence; identical to SEQ ID NO: 1752
  Cas9 variant

SEQ ID NO: 7553 - RNA, 3810 nt, Artificial Sequence
  Cas9 variant
augaacaacagcaucaaguccaagcccgaggugaccaucggccuggaccucggggucggcagcguggggugggccaucguggacaacgagaccaacaucauccaccaccugggcucccgccuguucagccaggccaagaccgcggaggaccggcgcuccuuccgcgggguccggcggcucauccgccggcgcaaguacaagcugaagcgguucgugaaccugaucuggaaguacaacagcuacuucggcuucaagaacaaggaggacauccucaacaacuaccaggagcagcagaagcugcacaacaccgugcugaaccucaaguccgaggcccugaacgccaagaucgacccuaaggcgcugagcuggauccuccacgacuaccugaagaaccgcggccacuucuacgaggacaaccgggacuucaacgucuaccccaccaaggagcuggccaaguacuucgacaaguacggguacuacaagggcaucaucgacuccaaggaggacaacgacaacaagcucgaggaggagcugaccaaguacaaguucagcaacaagcacuggcuggaggaggugaagaaggugcucuccaaccagacggggcugcccgagaaguucaaggaggaguacgagagccuuuucuccuauguccgcaacuacucugagggccccggguccaucaacagcguguccccguacggcaucuaccaucucgacgagaaggagggcaaggugguccagaaguacaacaauaucugggacaagaccaucgggaagugcaacaucuuccccgacgaguaccgggcgcccaagaacagccccaucgccaugaucuucaacgagaucaaugagcuguccaccauccgcagcuauagcaucuaucugaccggcugguucauuaaccaggaguucaagaaggccuaccucaacaagcugcuggaccuccugaucaagacgaacggggagaagccgaucgacgcccgacaguucaagaagcugcgcgaggaaaccaucgcggaguccaucggcaaggagacccucaaagacguggagaacgaggagaagcuggagaaggaggaccacaaguggaagcugaagggccucaagcugaacaccaacgggaagauccaguacaacgaucugucgucccucgccaaguucguucauaaacugaagcagcaccugaagcucgacuuccugcuggaggaccaguacgccacgcucgacaagaucaacuuccugcagagccuguucgucuaccucggcaagcaccuccgguacaacaaccgcguugacuccgccaaccugaaggaguucagcgacuccaaccggcuguucgagcgcgugcugcaggagcagaaggacgggcuguucaaguuguucgagcagaccgacaaggacgacgagaagauccucgcccagacccacagccuguccaccaaggcgaugcugcucgccaucacccggaugaccaaucuggacaacgacgaggacaaccagaagaacaacgacaagggcuggaacuucgaggccaucaagaacuucgaccagaaguucaucgacaucaccaagaccaacaacaaccugagccucaagcaggacaagcgcuaccuugacgaccgcuucaucaacgacgccauccugucccccggggucaagcgcauccuccgcgaggccacgaaggucuucaacgcgauccugaagcaguucagccaggaguacgacgugaccaaggucgugaucgagcuggcccgggagcucuccgaggagaaggagcuggagaacaacaagaacuacaagaagcugaucaagaagaacagcgacaagaucuccgagggccucaaggcccuggacaucgccgaagacaagaucgaggacauccucaagagccccaccaaguccuacaaggugcugcuguggcugcagcaggaccacaucgaccccuacagccagaaggagaucgcuuucgaggacauccucaccaagacggagaagaccgagaucgaccacaucaucccguacucgaucagcuucgacgacagcuccagcaacaagcugcugguccucgcggaguccaaccaggccaagagcaaccagacccccuacgaguucaucacguccgguaacgccgggaucaagugggaggacuacgaggccuacugccgcaaauucaaggacggcgacacgagccugcuggacuccacccagcggagcaagaaauucgccaagaugaugaaaaccgacaccuccagcaaauacgacaucggguuccucgcgcgcaaccugaacgacacuagauacgccaccauaguguuccgcgacgcccugaaggacuacgccaacaaccaccucgucgaggacaagcccauguuuaagguggugugcaucaacggcggggucaccuccuuccugcggaagaacuucgacaagagcugguacgcgaagaaggaccgcgacaagaacauccaucacgccguagacgccuccaucaucagcaucuucuccaacaagaccaagacgcuguucgaccaacucacccaguucgccgacuacaagcuguucaagaacaccgacggcuccuggaagaaaaucgaccccaaaaccggaguggucaccgaggugacggacgagaacuggaagcagauccgggugcgcaaccaggucuccaagauagccgaggagaucgacaaguguauccaggacagcaacaucgagcggaaggcgcguuacagccggaagauagagaacaagaccaacaucucccuguucaacgacaccguguacagcgcgaagaaggugggguacgacgaccagaucaagcgcaagaaccucaagacccuggacaucgacgaguccgucgaggagaauaagaacagcaaggugaagaaacaguucguguaccggaagcuggucaacgugucccuccugaacaacgacaagcuggccgaccucuucgccgagaaggaggacauccugauguaccgcgccaacccgugggugaucaaccucgcggagcagaucuucaacgaguacacggagaaccggaagaucaagagccagaacgucuucggcaaguacaugcucgaccugaccaaagaguuccccgagaaguucuccgaggccuucgucaagagcaugcugcgcaacaagaccgccaucaucuacaacguggagaagaagguggugcaccgcaucaagcggcucaaaauccuguccagcgagcuaaaggagaauaaacuuuccaacgugaucauccgcagcaagaacgaguccgggaccaagcugagcuaucaggacaccauaaacuccgucgcccugaugaucaugcggagcaucgaccccaccgccaagaagcaguacauccgcgugccccucaacacccugaaccugcaccucggcgaccacgacuucgaccugcacaacaucgacgcguaccugaagaagccuaaguucgugaaguaccucaaggccaacgagaucggggacgaguacaagcccuggcgggucuuaaucuccggcagccugcucauccacaagcgcgacaagaagcucauguacauuuccagcuuccagaaccugaacgaccucaucgagaucaagaaccugaucgagacagaauacaaggagaacguggacagcgaccccaagaagaagaagaaggccucccaaauccugagaagucucuccacgauccugaacgacuacauccugcucgacgccaaggacaauuucgacauccugggccugagcaagaaccgcauugacgagauccucaacuccaagcuggaccuggacaagaucgcgaaguga

SEQ ID NO: 7554 - RNA, 3822 nt, Artificial Sequence
  Cas9 variant
augaagaagauccuaggccuagacuuagggaccaacagcaucggcugggcccugaucgagguggaugagaacaacuuccccauacgcaucaucgccauggggucccggaucaucccgcucagcuccaacgacaaggacgaauuucagcgaggucugagcaucaccaagaaccagucccggacggucagccgcacccagcggaagggguacgaccgcaagcagcugaagaaguccgacgacuucaaguacagccuccggcgcauccugaacaaguacaacaucuuccccuccgaggagcugcucaagcugcccaugcuggaccucuggaagcugcgcagcgacgcggugaacccgaacgagaacaucuccgccgagcagcugggccgcauccucuacaugcugaaucagaagcggggcuacaagagcgcccgcuccgaggccaacgccgacaagaaggacaccgacuacgugcuggcggugaaggggcgguacgcacagcucaaggaccgcaaccaaaccauuggucaguacuucuacgaggagcugcacaacgccaagacaaccaacagcuacuuccggaccaaggaggagguguacccgcgcgaggcguacaucgaggaguucgacaccaucaucaacgcgcagaaguccaagcacgacuuccugacugacgaagugguccaccagcuucggaacgagaucauauacuuucagcgcaagcucaagagccagaagggguuaguguccaucugcgaguucgaaggcuucgagaagaccaucuucgacaaggagaaggacaagaauaagguggucuucgucgggcccaagguggcccccaagaccagcccccuguuccagcugugccggauuugggaggucgugaacaccaucacgcugaaaaucaagaacccggagggcuccaaguauaaauggggcgagaagaucccuaacaucaaggagaaggaggcccucgccgacuaucuguucaagaaugagacccugagcuucaacaagcuccuggacauccuggagcucaagaaggagaacguguacgucaacaagcagaucaucaaggggaucaagggcaacgagaccuacagcgcccugcaccgcauccugggggacaacgagcuccugaaguucgacguguccaucauccccagcaaccacaccuccaugcugguggacaagaagacgggcgagauccucgaggagcgggcgggccuggagcuggacgucagccucgagaaagagccccuguaccagcuguggcacaccaucuacuccauuaaggaccucgacgagugcaagaacgcccugaucaagcgcuucggguucgacgacgagaucgccgagaagcuaagccaccucgacuucaacaagcaggccuucggcaacaaguccaacaagagcaugcgcaagauccugccguuccugauggaaggguacaacuauucccagagcugcacccuggccggcuacaaccacuccaacagccucaccaaggacgagcgggagcagcaggucacgcucgacaaacuggagcuccugcccaaaaacucccugcgccagccuaucguggagaagauccucaaccagaugaucaacguggugaacgcgaucuuagaggaguacgggaagcccagcgagauccggaucgagcuggcccgcgagcucaagcaauccaaggacgagcggcacgacgccgaccugcagaacagcaagaacaagaaacuuaacgaggagaucggcaagcgccucaccgagcugggccugccggugaccaagagauacauccagaaguacaaguucaucuuccccucccucagcaagucccuaaaggacgcccaggucaacaaccagugcaucuacugcggggagaccuucaaccugacggaggcucucagcggcgacgcguacgacguggaccacaucguccccaagagccugcuguucgacgacucccagaccaacaaggugcucgugcaccgcaagugcaacagcaccaagaccaaccagacggccuacgacuacaucgccuccaagggggaggaggagguccagaucuacagcgcccggguggacgacugguucaagcgcggcaucaucucuuacagcaagaugcagcgguugaaggugucccacaaggaguaccuggagcgcaagucacucaacaaggagaccgagaccgacaagaagcugugggagaacuucaucgaccggcagcugcgcgacacccaguacaucucccgcaagagcaaggagauccuccagaaggucugcaacaacgugacgaccaccgagggcggggugaccgccaagcugcgggaccuguggggcugggacgacauccucaugaaccugcagaugcccaaguacaaggagcugcggcaaacggucaucaaggaguggaccuccgagcacgggaagcgcaaacaccagaaggaggagaucgagaacuggaccaagcgggacgaccaccgccaccacgcgaucgacgcccucguuaucgccuguaccaagcagggcuucauccagcgcaucaauacccugaacagcuccgagacgaaggaccucaugcagcaggagaucaacgaggccaagaagcuccugggggagaacuacaaggacaaggaguucgagaacagcaacgagcuggugaagaaccacaagggccggcucuccaaacuggacgacuaccugcgccuccaaaagccgaucaaguucaacaccaaguacgucgagaaggaggcggacaagauccugaucagcuucaaggccgggaagaagguggccaccaucacaaaguucaaggccacgggcaagaacaaggacaccggcgugaucgucccccgcggggcccugcacgaggcgggccucuacggggugcggaccaucuacagcaagggcggcaucgccgagaagcacaucaucaagaaguacaagguggggguuagcgcccaggaccacaucuucaccggcaaggagagcuacuccgugaagaaggacaagaacgggaacgagaagguggacgacaagaucaaagucgugcuggacagcaucguggacuccaaggucaaggagaucgugcugaaccggcucaacuucggcuucagcgacggggaggacuacaagaacaacgugaagaaggcccugaauaacuucaagaaccuggacgaguacccccucugguacaacgagaacaagggcaucaagauccuguccaucaagcugaagacgggccucaaggacagcgucgugccccugcgccugaacgaguccaacgaggugaucacccucgucaagaccgguaacaaccaccacaucgcuaucuacgaggacaagaacagcaagccggugcagcacuccugcaccuucuggcacgcgguggagcggaagaaguauaacauccccgccgucaucaagaaguccagcgacguguggaaccagcugcuggacaaggagcuccccgagagcuuccugaacaaccugcccgaggacaaccucaaccugaaguucuccaugcagcagaacgagauguucgugcugggccucagccaggaggaguucaaggaggccauagagaacaacgacaagucccugcugucaaaguaccucuaccuggucugguccgugagcgagaacaacuacugguuccgccaccaccuggagacgaagaacuccgaccucaagaagaccgagggggccaaggagagcaagcggcuauacaacauccgcagcguauccagccuguucucccucaacccggucaaggugcggcugaaccaccugggcgagaucaccaagaucggggaguacuga

SEQ ID NO: 7555 - RNA, 3825 nt, Artificial Sequence
  Cas9 variant
augaccaagcacauccugggccucgaccuggggaccaacagcaucggcugggccaucauccagguugacaacaacaacaacguccccauccagaucaucgccauggggucccgcaucaucccacuggacagcaacgaccgggaccaauuccagaagggccaagcgaucuccaagaacaaggaccgcacuaccgcccggacacagcgcaagggguacgaccggaagcagcucaagaaguccgacgacuucaaguacagccugaagaagauccuggagaagcucgacaucuuccccaccgaggagcugaugaagcugcccacgcucgaucuguggaagcugcgcagcgacgccguguccaacaucgaggacaucacccccaagcagcucggccggauccuguacaugcugaaccaaaagcgcggcuacaagagcgcccgauccgaggccaacgcggacaagaaggacaccgacuauguggccgaggucaaggggcgcuacacccagcucaaggauaagggccagacgcuggggcaguacuucuacaaggagcugagcgacgccaaccagaauaacaccuacuaccgggugaaggagaagguguacccgcgcgaggccuacaucgaggaguucgacgcgaucaucaacguccagaaguccaagcacagcuuucucaccgacgaggugauccacucccugcggaacgagaucaucuacuaccagcgcaaacucaagagccagaagggccugguguccaucugcgaguucgagggguucgagaccacguacuucgauaagaagacccagcaggacaagaccaucuucaccggccccaaggucgcgccccggacgagcccccuguuccaguucugcaagaucugggagguggugaacaacaucucccugaagaccaagaacccggagggcucgaaguacaagugguccgaccgcauccccacaaucgaggagaagcagaccaucgccaacuaccuccaggagaacgagaaccugagcuucaucgagcugcucaagauacugcagcugaagaaggagcaggucuacgccaacaagcagauccucaaggguauccagggcaacacgaccuucuccgccauccacaagaucaucgggaacuccgagcaccugaaguucgacaucgagaccauccccagcaagcacuucgccgugcugguggacaagaagaccggcgaaauccucgaugagcgggacucccuggagcugaacagcgcccucgagcaggagcccuucuaccagcuguggcauacuaucuacuccaucaaggaccuggacgagugcaagaaggcccucaucaagcgcuucaauuucgaggaggagaucgccgagaagcugagcaagaucgacuucaacaagcaggccuucgggaacaaguccaacaaggcgaugcguaagaugcugccguaccucauguugggguacaaccagagcgaggccgaguccuucgcaggcuacaaucgccggcugaccaaggaggagaaguccaagaacgucagcgacgagccccuacagcugcuggccaagaacagccuccgccagcccgugguggagaagauccugaaccagaugaucaacgucgugaacgccaucaucgagaaguacgggaagcccgaggagauccgcguggagcuggcgcgggagcugaagcaguccaaggacgagcgcgaggacgccgacaaacagaacggcuucaacaagaagcucaaugagcuggucgccaccaagcugaccgagcucgggcugccgacgaccaagcacuacauccagaaguacaaguucaucuucccagccaaggacaagaacuggaaggaggcccagguggcgaaccagugcaucuacugcggcgacaccuucaacuugaccgaggcccucagcggcgacaacuucgacguggaucacaucguccccaaagcccugcuguucgacgacucccaggccaacaaggugcucguccaccggagcugcaacuccacgaaaaccaacaacaccgcguacgacuauaucaccaagaaagggagccaggcccugaacgacuacguggcccgcguggacgacugguucaagcgcggcaucauauccuacgguaagaugcagcgccuuaaagucagcuucgaggaguaccaggagcggaagaagaucggcaaggagacggaggccgacaagcgcaucugggagaacuucaucgaccggcagcuccgcgagaccgccuacaucgcgaaaaaggccaaggagauucuggagaaggugugccacaacgugaccagcaccgaggggaacgucaccgccaagcugcggcagcucuggggcugggacaacgugcugaugaaccugcagcuccccaaguacaaggagcuggagaagaagacgaagcagaccuucacccaacugaaggaguggaccuccgaccacggcaaccgcaagcaccagaaggaggagauaaucaacuggacgaagcgggacgaccaccgccaccacgccaucgacgcgcucgugauugcgugcacccagcagggguucauccagcggaucaacacccugagcuccagcgacgucaaggacgagaugaagaaggagcuggaggaggacaaaaccguguacaacgagcgccucacgcugcuggagaacuaccuccuggagaagaaaccguucuccaccgaggagaucgagaaggaggccgacaagauccuggugagcuucaaggccggcaagaaggucgccacacucuccaaguacaaggccaccgggaucaacgagaucaagggcgugcuggugccccgggggccccugcacgagcagagcgucuacggcaagaucaaggugaucgagaaggacaaaccccucaaauaccuguucgagaacuccgacaagaucgugaacccgcugaucaagcaccucgugaagacgcgccugcuggagaaugagaacaacgcgcaggccgcccucgugacccugaagaacaagcccauccugcucaacaacaagcagaccgagauccuggagaaggccagcugcuacaacgaggcgaccgugcugaaguacaagcuccagucccugaaggccagccagaucgacgacaucgucgacgagaagaucaaguuccugaucaaggagcgccucuccaaguucgggaacaaggaaaaggaggccuucaaggacauccugugguucaacgagaagaagcagauccccaucaccagcauccgucuguucgcccgccccgaugccaacaaccuccaggugaucaagaagcacgaaaaggggaagaacaucggcuucgugcuguccgggaauaaccaccacaucgcgaucuacgaggacaagaacaacaagcugauccagcacaucugcgacuucuggcacgccgucgaacggaagcgcaauaacaucccggugcucauugaggauaccagcaccaucuggaaccaccugaucaacgaggacuucuccgagagcuuccugaacaagcuccccaacgacagccugaagcugaaguucagccuccagcagaacgagauguucauccugggccugcccaaggagcagagcgaggaggccaucaagagcaacaacaagagccuccuguccaagcaccuguaccucguguggagcaucaccgacggugacuacuucuuccggcaucaucuggagacgaagaacaccgaguuaaagaagaucgacggcuccaaggaaagcaagcgcuacuugcggcuguccaccaagagccuggucgaucucaacccgauuaaggugcgccugaaccaccugggcgagaucaccaagaucggggaguga

SEQ ID NO: 7556 - RNA, 3846 nt, Artificial Sequence
  Cas9 variant
auggaagacgacucacaacacgacaucagagaaaucuaccucgccauacaccacauggucaaauacagaggcaauuuccuagucgagggaacccucgaaagcaguaacgcuuucaaagaagacgaauugcucaaacuccugggacgaaucacgcgauacgaaaugagcgagggggaacaaaauucagacauagaacaagacgacgagaauaaauuaguggcacccgcaaauggacagcuugccgacgcgcuuugugcuacgcgggggagccgcagcaugagaguagacaacgcccucgaagccuuauccgcgguaaacgaccuaucccgggagcaacgggcgaucgucaaagcaaucuucgcaggccuagaagguaacaagcuagaccuagcuaaaaucuuugucaguaaagaguuuagcucggaaaauaaaaagauccuagggaucuacuucaacaaaagcgacuacgaagaaaaaugcgugcagauagucgacuccggacuacucgacgacgaagaaagagaguuccuggaccgcaugcagggccaguacaacgccaucgcacugaaacagcuacucggaaggagcaccuccguaagcgacagcaaaugcgcuuccuaugacgcgcacagagccaacuggaaccugaucaaacuccaauuacggacaaaagaaaaugagaaagacaucaacgaaaacuacgggauucucgucggauggaagauugauuccggccaaagaaaauccgucagaggagaaagugcauacgagaacaugcggaagaaagcgaacguguucuucaagaaaaugauagaaacgagcgaccuaucggaaacagacaaaaacaggcuaauccaugauaucgaagaggacaaacuauucccgauccagcgagauucugacaacgggguaaucccgcaccaacuccaccagaacgaguuaaagcaaaucauuaagaaacaagggaaauacuacccuuuccuuuuggacgcguuugaaaaggacggcaaacagauaaacaagauagagggcuugcuagcguucaggguaccguacuucgugggaccccuagucguacccgaagaccuacaaaagagcgacaauuccgaaaaccauuggauggugagaaagaagaaaggggagauaacccccuggaacuucgacgaaauggucgacaaagaugccaguggcagaaaauuuauagagcgacucguaggcaccgacucguaccuccucggagaaccaacgcugccuaaaaacucccuacuauaccaggaauacgaaguccuuaacgaacucaacaacguucgacuaagcgucaggaccggcaaccacuggaaugacaagcgcagaaugagacucggaagagaagaaaagacccugcucugccagcgccuuuucaugaaaggacaaacugugaccaaacgcacagccgaaaaccuacuccgcaaggaguacggccgcacuuacgagcuaucgggacuaagugacgaaucaaaauucacguccagccuaucgacauauggcaaaaugugcaggauuuucggcgaaaaguauguuaacgaacaccgagaccucauggaaaagaucgucgaacugcaaacgguauucgaagacaaagagacguugcuccaccagcugcgacaacucgaaggcauaagcgaggcagacugcgcgcuccuuguuaacacccacuacacaggauggggcagacuaucaagaaaacuccuaaccacaaaggcgggcgaaugcaaaauuagcgacgacuucgcaccgcgaaaacauuccaucaucgaaaucaugcgcgccgaagauagaaaccugauggaaaucauaacagacaaacagcugggcuucagcgacuggauagagcaggaaaaccugggagccgaaaacggcagcucgcugauggaaguagucgacgaccuacgggucagcccaaaaguaaaacggggcaucauccagagcauccgccucaucgaugacaucuccaaagcggucggcaaacgccccagccgaauuuuccucgaacucgcagacgacauacaaccaucaggccggaccaucagccgcaaaagccgacugcaagaccucuaccgaaacgcuaaccucggaaaagaguucaaaggaauagccgacgaacucaacgccugcucagacaaagaccuccaagacgaccgacucuuccucuauuacacccaacucgggaaagauauguauacaggggaagaacucgaccuagaccgccuauccucugcauacgacaucgaucacauaauaccacaggcaguaacgcagaaugauucgaucgacaaccgcguccuagucgcacgcgcagagaacgcgcgcaagacagacagcuucaccuacaugccccagaucgcugaccgaaugcgaaacuuuuggcagauccugcuggacaacggacuaauuaguagagucaaauucgaaagacuaacaagacaaaacgaguucagugaaagagaaaaagaacgauucguacaaagaucccuuguagaaacacgacaaaucaugaagaacguugccacccucaugcggcaaagauacggcaacucggcagcaguaauagggcugaacgcggaacuaacaaaagaaaugcaccgcuaccucggcuucagccauaaaaaccgagacaucaaugacuaucaccacgcccaggacgcacucugcguagggauagccggccaguucgcagccaaccgaggguucuucgccgacggggaggucuccgacggggcccaaaacucauacaaccaauacuuacgggauuaccugcgcgguuaccgagaaaaacuaucggccgaggaccgcaaacagggccgcgcauucggguucauagucggaagcaugcgcagccaggacgaacagaaacgggugaaccccaggaccggggaaguugucuggagcgaggaagauaaagacuaccuaagaaaagugaugaacuaucgaaagaugcucguaacacaaaaaguaggcgacgacuucggagcccucuacgacgaaacacgcuacgcagcaaccgaccccaaggggauaaagggaauaccguucgacggcgccaagcaagacacuagccuguacgggggauucucaucggcaaaacccgccuacgcaguauuaaucgagagcaaagggaagaccaggcuagugaacguaacaaugcaggaguauucucugcucggcgacagaccauccgaugacgaacucagaaaaguacuugccaaaaagaagucugaauacgcaaaagccaauauccugcugcgccacguccccaagaugcaacucauacgguacggcggaggacuaaugguaaucaaauccgccggcgaacuaaauaaugcgcaacaacuguggcuaccguacgaagaguacugcuacuucgaugaccugucccaaggcaaaggcucccuagagaaagacgaucucaagaaacuccuggauuccauccucggaucuguccagugccucuaccccuggcaccgcuucaccgaggaagaacuagcggaccuccacgucgcauucgacaaauuaccagaggacgaaaagaaaaaugucauaaccggcauugucucggccuuacacgcagacgccaaaaccgcuaaucuuagcaucgucggaaugacagggucauggcgccguaugaauaacaaauccggauacacauucagcgacgaagacgaguucaucuuccaaucccccuccggacuauucgagaaaaggguuacggugggggaacuaaaacggaaagcaaagaaagaagucaacucgaaauaccgaaccaacgagaaaagacugcccacgcuaucaggggccucacaaccauga

SEQ ID NO: 7557 - RNA, 3861 nt, Artificial Sequence
  Cas9 variant
augaccaagaacauacugggccucgaccuggggaccaacagcaucggcugggccuugaucgagguggacgaaaacaacacgcccauccggaucauugccauggggucccggaucaucccgcucagcacuucggacaaggaagaauuucagcgcggcuugagcaucaccaaaaaccagucccgaaccgucagccgcacgcagcggaagggguacgaccgcaagcagcugaagaaguccgaccucaaaaagauccugaacaaguacaacaucuucccaagcgaggagcugcucaagcuccccaugcuggaucucuggaaguuaagauccgacagcgcgaaccccaacgaaaacauuucagccgagcagcugggccgcauccucuacaugcucaaccagaagcgaggcuauaagagcgcucgcuccgaggccaaugccgacaaaaaggacaccgacuacgugcaggcggugaaggggcgguacgcccagcugaaggagcgcaaccagaccaucggccaguacuucuacgaggagcucuauaacgccaacaccaacaacagcuacuuccggaucaaggaggaggucuacccgcgcgaggccuacacggaagaguucgacaccaucaucaacgcgcagaaaaacaagcacgacuuccugaccgacgaagugguccaucagcugcggaacgagaucaucuacuuucagcgcaagcucaagucccagaaggggcuugucagcauuugcgaguucgagggcuuugagaagaccguuuucgauaaagagaagaacaaggacaagguggucuucguagggucgaagguggcccccaagacgagcccccuguuccagcucugccggaucugggaggucgugaacaccaucagucugaagaucaagaacccagagggaagcaaguacaaguggggcgagaagaccccuaaccugaaggagaaggaaaucuuggccgacuaccuguucaaaaacgacagccuguccuucaccaagcuccuggagauccuggaccugaacaagaaugacguguacgucaacaagcagauacugaaggggaucaagggcaaugagacguucagcgcccuacacaccguguugggggauaacgagcugcugaacuucgauguguccaucaucccgagcaaccacaccuccaugcucgucgacaagaagaccggcgagauccuggaggagcgcgccggccuagagcucgacgcgagccuggagaaggagcccuuauaccagcucuggcacacgaucuauucccugaagguucuagacgagugcaagaacgcccucaucaaaagguucggguuugacgacgagaccgcagagaagcugucgcacauugacuucaacaagcaggcauucggcaacaagucgaacaagagcaugcgcaagauccugcccuuccugauggagggguacgacuacucccagagcugcucucuagccggguacaaccacagcaacucccuaacaaaggacgagcgggagcaacagaucacgcuggaccgccucgagcuacuaucuaaaaacucccuucgccagccgaucguagagaagauccugaaccagaugaucaacgucgugaacgcgauccuggagcaguacggcaagcucagcgagaucagagucgagcuggcucgcgagcugaagcaguccaaggacgagcggaacgacgccgacuugcagaacucaaagaacaaaaagcugaacgaggagaucggcaagcgucuggccgagcucggccugcccgucacgaagcgguacauccaaaaauacaaguucaucuucccaagccuguccaagaaccucaaggacgcccacgugaacaaucagugcaucuacugcggggagaccuucaaccugaccgaggcgcugucuggcgacgcguucgacgucgaccacaucgugcccaaggcccuccuguucgacgauucgcagaccaacaaggugcugguccaucgcaagugcaacagcacgaagaccaaccagaccgcuuacgacuacaucgggaccaagggagaggaacagguccggauuuacuccgagcgcguggacgacugguucaagcgggggaucaucucguacuccaagaugcagcgccugaaggugagccacaaggaguaccuggagcggaagaagcugggcaaggagacggagaccgacaagaagcucugggagaauuucaucgaccgccagcugcgggacacccaguacaucucucgcaaggcccgugagauccugcaaaaggugugcaacaacgucaccacuaccgaaggcgggaucaccgcgaaacuccgcaaccugugggggugggacgacgugcuaaugaaccuccagaugccaaaguacaaggagcuggggcagaccguaaucaaggaauggacgagcgagcauggcaagcggaagcaccagaaggaggagaucgagaacuggacgaagcgcgacgaccaccggcaccacgccaucgacgcucugguugucgccuguaccaagcagggguucauccaacgcauuaacacccucaacuccagcgauaccaaggaccugaugcagcgcgagaucaaggaagcaaagaagcuacucggcgagaacuacaacgagaaggaguucgaaaacgacaacgaguucguuaagaaccacaaggagcguuugucccagcuggacgacuaccuccgccugcagaagcccgugaaguucgacacgaaguacgucgagcaggaagccgacaaggugcuggugagcuucaaggccggaaagaaggucgccaccauaaccaaguucaaagccaccgggaagaacaaggacacgggcgugauaguccuccgcggggcgcuccacgagcaauccgucuacggcaagaucaaggugauugagaaggauaagccccugaaguaccucuucgagaacagcaagaaaaucgucaaccccaagauuaagguccuuguagaggagcggcuggccgagaacgagaauaacucaaagcucagcuuaaguacccugaaaaagaacccgaucuuccucaacgaggagaagacagagauucuggagaaggccagcugcuacaacgacgccaccgugcugaaguacaagcuccagucccugaaggccucacaggcggacgacaucguagacgaccggguuaaguuccuggugaaagagcgccucgcccaguucggcaacaaggagaaggaggccuucaaagacacacuguggcugaacgaggagaagcagauucccauuauaaccguccgcuuguuugcccggcccgacgccaacaacuuacaggcgaucaagaaggacaagaacgggcgggacaucggcuuugugcugacggguaacaaccaccacaucgccaucuacgaggacaaggacaacaagcucgugcagcauagcugcaccuucuggcacgccgucgagcgcaagaaaaacaacguccccgccgugauaaagaacuccagcgacgucuggaaccagcuucuagauaaagagcuccccgaguccuuccugaacaagcugcccaucgacaagcucaagcugaaguucagccugcagcagaacgaaauguucgugcucggccugcugcaggaggacuucgaggcggccauagaaaacaacgauaaaacgcuccuguccaaacaccucuaccucguguggagcauuaccgacggggacuacuucuuccggcaccaccuggagaccaaaaacaccgagcugaagaagacggagggugccaaggaguccaaacgcuacuuccggcucucgaccaagggccugaucgaccugaaccccgucaaggugcgccucaaccaccugggggagaucaccaagaucggcgaguauuga

SEQ ID NO: 7558 - RNA, 3864 nt, Artificial Sequence
  Cas9 variant
augaagaccgugcugggccucgacuuagggaccaacagcaucggcugggcccugaucgagcucgacgagaacaacauccccauccgcaucgucgccauggggucccggaucaucccgcugagcacuuccgacaaggaggaguuccagcgcggccugagcaucaccaagaaccagucccggaccgugagccggacccagcggaagggguacgaccggaagcagcucaaaaaguccuaccugaagaagauccugaacaaguacaacaucuuccccagcgacgagcuccugaagcugcccauguuagaccucuggaagcugcgguccgauagcgcgaaucccaacgagaacaucuccgccgagcagcucggccgcauccuguacaugcugaaccagaagcggggcuacaagagcgcccgcagcgaggccaacgccgacaagaaggacacggacuauauccaggccgugaaggggcgauacgcccagcucaaggaccgcaaccagaccaucggccaguauuucuacggggagcugaacgacgccaacgagaacaacagcuacuuccgcaucaaggaggaggucuacccgcgcgaggccuacaccgaggaguucgacaccaucaucaacgcgcagaaggacaagcacgacuuccugacggacgaggugauccaccagcuccggaacgagaucaucuacuuccagcgcaagcugaagucccagaagggccugguauccaucugcgaguucgaagguuuugagaagaccgucuucgauaaggagaagaacaaggacaaggugguguucgucggccccaagguggcccccaagaccagcccccucuuccagcugugccggaucugggaggucgucaacaccaucacgcugaagaucaagaacccggagggcagcaaguacaaguggggcgagaagauccccgacgugaaggagaaggagauccuggccgacuaucuguucaagaacgagucccugagcuucaccaagcuccuggagauccugaagcucaacaagaacaacguguacuucaacaagcagauccugaaggggaucaaggggaacgagaccuacagcauccugcacuccaucuuaggcgacagcgagcugcugaacuucgacgucuccaucauccccagcaaccacaccucuaugcucaucgacaaaaagacgggcgagauccuggaggagcgcgccgggcuggagcucgacaccagccuggagaaggagccccugaaccagcucuggcacaccaucuauuccaucaaggaccuggacgaguguaagagcgcccugaucaagcgguucggcuucgacgacgagacggcggacaagcucucccgcaucgacuucaacaagcaggccuucgggaacaagagcaacaagagcaugcggaagauccugccauuccugauggagggcuacgacuacagccaguccuguagccuggccggguacaaccacuccaacagcuucacgaaggacgagcgcgagcagcagaucacccuugauaagcuggagcugcuccccaagaacucccugcgccagcccaucguagagaagauccugaaccagaugaucaacguggucaacgccauccucgagcgguacggcaagcccagcgagauucgcguggaacuggcucgugagcugaagcaguccaaggacgagcgcaacgacaccgaccuccagaacagcaagaacaagaagcugaacgaggagaucggcaagcggcuggcggagcuugggcugccgcugaccaagcgcuacauccagaaguacaaguucaucuuccccagccucuccaagaaccugaaggacgcccacgugaacaaccagugcaucuacugcggcgagacguucaaucugaccgaggcccucagcggggacgccuucgacgucgaccacaucgugcccaaggcccugcuguucgacgacucccagaccaacaaggugcucguccaccggaagugcaacagcaccaagacaaaccagaccgcguacgacuacaucgccacuaagggcgacgagcaaguccgcguguacuccgagcguguggacgacugguucaaacgcgggaucaucagcuacuccaagaugcagcggcugaaaguaagccacaaggaguaccuggagcgcaagaagcucggcaaggagaccgagacggacaagaagcugugggagaacuucaucgaccggcaguugcgcgacacccaguacaucucccggaagucccgcgagauccuccagaaggucugcaacaacguggccaccaccgagggcggggugacggccaagcugcggaaccuguggggcugggacgacguccucaugaaccugcagaugcccaaguacaaggaacugggucagaccguggugaaggaguggaccuccgagcacggcaagcgcaagcaccagaaggaggagaucgagaacuggacaaagcgggacgaccaccgccaccacgccaucgacgcgcucgucguugccugcaccaagcagggguucauccagagaaucaacacgcugaacagcuccgagaccaaggaccugaugcagcaggagaucaaggaggccaagaagcuccugggcgagaacuacaaugagaaggaguucgagaacaacaacgagagcgugaagaaccacaaagagcggcugucccaacucgacgacuacuugcgccugcagaagccggucaaauucgacaccaaguacguggagcaggaggccgacaaggugcucgugagcuucaaguccggcaagaagguggcgaccaucacgaaguucaaggccaccgggaagaacaaggacaccggcgugaucgucccccgcggggcccugcacgagcagaacguguacggcaagaucaaggugaucgagaaggacaagagccugaaguaccucuucgagaacagcgaaaagaucgucaacccgaaaaucaagaacaucguggagaucauccuguccgagaacgagaacaacucaaagauggcccuguccacccugaagaagaaccccaucuuccugaacgaggagaagacggaccugcucgagaaggccagcugcuacgaguacgugaccguccggaaguacccgcugaacacaaucaaggcgucccaggccgacgacaucguggacgagcgggugaaguuccuggucaaggagcgccucacccaguucggcaacaaggagaaggaggccuucaaggacacgcugugguuuaacgaggagaagcagauccccaucaucaccgugcggcuguucgcccgcccugacgcgaacaaccuacaggcgaucaagaaggacgagagcgggaaggaaaucggguucguggucauggggaacaaccaccacaucgccaucuacgaggacaaggacggcaagcuagugcagcacuccugcaccuucuggcacgccguggagcggaagaaauacaacaucaguaccgucaucaagaacuccagcgacgccuggaaccaguuccuggacaacgagcuccccgaaccguuccugaacaagcugcccgccgacaaccucaaccugaaguucucccugcagcagaacgagauguucauccucgggcugagccaggaggaguucgacaaggcgcugaaguccaacgacaagagccuccuguccaagcaccuguaccucguguggagcaucuccgagaacaacuacugguuccggcaccaccuggagacgaagaacagcgaccugaagaagaccaacggcgugaaggaguccaagcggcucuacaauauccgcagccugggcagccuguucucccucaaccccaucaagauccggcugaaccaccugggggagaucaccaagaucggcgaguauagcuga

SEQ ID NO: 7559 - RNA, 3867 nt, Artificial Sequence
  Cas9 variant
augcgucuguucgaggagggccacaccgcggaggaccggcgccucaagcgcaccgcccgccgacgcaucagccgucgccggaaccgccugcgguaccugcaagcguucuucgaggaggccaugacggaccucgacgagaacuucuucgcccgcuuacaggagucuuuccuggugcccgaggacaagaaguggcaccggcauccgaucuucgccaagcucgaggacgaggucgccuaccacgagaccuaccccaccaucuaccaccuccgcaagaagcuggcggacagcuccgagcaggccgaccuccggcugaucuaccuggcccucgcacacaucgugaaguaucgcgggcacuuccugaucgagggcaagcugaguaccgagaacacguccgugaaggaccaguuccagcaguucauggucaucuacaaccaaaccuucgugaacggggagagccggcucguguccgcgccccugcccgagagcguccugaucgaggaggagcucaccgagaaggccucgcgcaccaagaaguccgagaagguguuacagcaguucccgcaggagaaagcuaauggccuguuugggcaguuccucaagcugauggugggcaacaaagccgacuucaagaaggucuucggccuggaggaggaggccaagaucacguacgcgagcgaaagcuaugaggaggaccuugaggggauccuggccaaggugggcgacgaguacuccgacguguuccuggcggcaaagaacgucuacgacgccguggagcucagcaccauccuggcugacuccgacaagaagucccacgccaagcugagcagcuccaugaucgugcgguucaccgagcaccaggaggaccucaagaaguucaaacgcuucauacgggagaacugccccgacgaguacgacaaccuguucaagaaugagcagaaggacggguacgccggcuauaucgcccaugccgggaaggucagccagcugaaauucuaccaauacguuaaaaagauaauccaggacaucgcgggcgccgaguacuuccucgagaagaucgcccaagagaacuuccugcgcaagcagcgcaccuucgacaacggggugaucccccaccagauccaucuggccgagcuccaggccaucauccaucggcaggcggccuacuaccccuuccugaaggagaaccaagagaagaucgagcagcuggucacguuccgcaucccguauuacguagggcccuuaagcaaaggcgacgccuccaccuucgccuggcugaagcggcagagcgaagaacccauccgccccuggaaccugcaggagaccguggaccucgaccaguccgcgaccgccuucaucgagcggaugacgaacuucgacaccuaucucccgagcgagaagguccuuccuaagcacucccuccuguacgagaaguucaugguguucaacgaacucaccaagaucagcuacacugacgaccgcgguaucaaggccaacuucuccggcaaggaaaaggagaagaucuucgacuaccuauuuaaaacgcggcgcaaggugaagaagaaggauauuauccaguucuaccggaaugaguacaacaccgagauagucacccuuagcggacuggaagaggaccaguuuaacgccuccuucagcaccuaccaggaccugcucaagugcgggcugacgcgcgccgagcuggaccaccccgacaacgcggagaagcucgaggauaucaucaagauccugaccaucuucgaggaccgucagcgcauccggacccaguuguccaccuuuaaaggucaguucagcgccgagguguugaagaagcuggaacgcaagcacuacacgggguggggccgguuauccaagaaacucaucaaugggaucuacgacaaggaauccggcaagaccauccuggacuaccuuguuaaggacgacgguguguccaagcacuacaaccgcaauuuuaugcagcucaucaacgacucucaacuuuccuucaagaacgcaauccagaaggcccagagcuccgagcacgaggagacgcuaagcgagaccgugaacgaacucgccgggagccccgcgaucaagaagggcaucuaccagucccugaagaucgucgacgagcugguggccaucaugggguacgccccgaagcggauuguggucgagauggcccgcgaaaaucagacgaccagcaccggcaagcggcgcuccauccagcgccucaagaucguggaaaaggccauggcggaaaucgggagcaaccugcugaaggagcagcccaccacgaacgagcaguuacgggacacccgccuguuccuguacuacaugcagaacggcaaggauauguacaccggcgacgagcucucccugcaccggcugagucacuacgacaucgaccacaucaucccccaguccuucaugaaagacgacagccucgacaaccuggugcuugucggauccaccgagaaccgcggcaagagcgacgacguaccauccaaggagguggucaaggacaugaaagccuacugggagaagcucuacgccgccgggcugaucagccagcgaaaguuccagaggcugaccaaaggcgagcagggcgggcucacgcuggaggauaaggcgcacuucauccagcggcagcugguggaaacacgccagaucaccaagaacguggccggaauccucgaccaacgguacaacgccaaguccaaggagaagaagguccagaucaucacccuaaaggccagccugacgucccaguuccggagcaucuucgggcucuacaaggugcgggaggugaacgacuaccaccaugggcaggacgccuaccugaacugcgucguugcaaccacccugcucaagguguacccgaaucuggcccccgaguucgucuacggggaauacccaaaguuccagacguucaaggagaauaaggccacggccaaggcaaucaucuacaccaaccugcuccgcuucuucacagaggacgagccccgguucaccaaggacggcgagauccugugguccaacagcuaucugaagacgaucaagaaggagcucaacuaccaccagaugaauaucgugaagaagguggagguccagaagggcggguucagcaaggaguccaucaagccgaagggccccuccaacaaacucauccccgugaagaacgggcuggacccccagaaguacggcggguucgacucccccgugguagcguacaccguccucuucacccacgagaagggcaagaagccccugaucaagcaggagauccugggcauaaccauaauggagaagacgagguucgagcagaaccccauccucuuccuugaggagaagggguuccugcggccgcgcgugcucaugaagcugcccaaguacacccuguacgaguuccccgagggccggcgccggcuccuugcgagcgccaaggaagcccagaaggggaaccagauggugcugcccgagcaccuccugacccugcucuaccacgccaagcagugccugcugccgaaucaguccgagagucucgcguacguggagcagcaccagcccgaguuccaggaaauccuggagcgcgugguugacuucgccgaggugcacacccucgccaagucgaaggugcagcaaaucguuaagcuguucgaggcgaaccagacggcagacgugaaggagaucgccgccagcuucauccagcuuaugcaguucaacgccaugggcgcccccuccaccuucaaguucuuccagaaggacaucgagcgggcgcgcuacaccagcauaaaggagaucuucgacgccacaaucaucuaucagucccccacggggcuguacgagaccaggcggaagguggucgacuga

SEQ ID NO: 7560 - RNA, 3903 nt, Artificial Sequence
  Cas9 variant
auguggggcguuagccuguucgaggccgggaagaccgccgcggagcgccggggcuaccgcuccacccggcgccggcucaaccaccgcaaguuccggcugcgccugcucgaggacauguucgagaaggagauucuguccaaggaucccuccuucuucaucaggcugaaggaggccuuccuuagcccuaaagacgagcagaagcaguucaagggaaauauacuauucaacgacaaggacuacacggacgccgacuacuacgagcaguacaagaccaucuaccaccuccgcuaugaccucaucucccagcaccggcaguucgacauucgcgaggucuaccuggccauacaccaccugaucaaguaccggggccacuucaucuacgaggaccagacuuucaccacggacgggaaccagcuccagcaccauaucaaggccaucaucaccaugaucaacagcacccugaaccgcauaaucauccccgagaccaucgacaucaacguguucgagaagauccugcucgaccggaugaugaaccgcuccagcaaggugaaguuccugauagagcugacgggcgaggacaagcaggacaagcccuuacugaaggagcuguuuaaccucauagugggccugaaggcaaagcccgccuccaucuucgagcaggagaaccuggccaccaucguggagaccaugaacaugagcaccgaacagguucaguuagacuuacugacgcucgccgacguccuggcggacgaggaguacgaccugcuccugaccgcccagaagaucuacuccgcuauaauccuggacgagagcauggacgguuacgaauacuucgccgaggccaagaaagaguccuaccggaagcaccaggaggagcucguacuggugaagaagauguuaaagagcaacgcgaucaccaacgaugaacgcgccaaguucgaguacuucuacaccgacuacaucggcgccaaguccagcaacuaugaggaguccaagaacaucaagaagggccugagugccgccuacggcaaguacuccaaggaggagcgccuguuuaagcacaucgaacugcuccuggcaaaagagaacguccugacgaccguggagcacgcccucuuagagaagaacaucaccuucgccagccugcucccgcugcagcgcagcucccggaacgccgugauccccuaccagguccacgaaaaggaauugguagccauccucgagaaucaggcgaccuacuaccccuuccuacuggaacagaaggacaacauccacaagcugcugacguuccgcauccccuacuacguggggccgcuggccgaccagaaggacagcgaguuugccuggaugguccgcaagcaggccggcaagaucacccccuucaacuucgaggagaugguggacaucgacgccuccagcgaggcguucaucaagcggaugaccaacaaaugcaccuaccugauccacgaggacgugauccccaagcacuccuucagcuacgccaaguucgagguccucaacgagcugaacaagauccgcuuggauggcaagcccaucgacaucccgcucaaaaagcggaucuucgaggggcuguuccuggagaaaacgaaggugacccagaccucccucaagaaguggcuggccgagcacgagcacaugaccgugagcguagugcaaggcacacagaaggagaccgaguucgcuacuagccugcaggcguuccaccgcuucgugaagauuuucgaccgggagaccgucagcaacccugccaacgaggaaauguucgagaagaucaucuacugguccacaguguucgaggacaagaagaucaugcgccggaagcucagcgaguacccccaguuaaccgagcagcagcagguccagcuggcccaggugcgguuccggggguggggccggcucagccagcggcugaucaaccgaaucaagacccccgugagcggcgacgaggaccacaaguuauccauaaacgaaauccucuggcagaccaacgaaaacuucaugcagaucauccggaacaaggauuaccuguuuaagaagaucaucgaggagcaguucgagaacgagacggccuugcucaacaagcagcgcaucgaugaacuggccgcgagcccggccaacaagaaggggaucuggcaggccaucaagaucgucaaagagcuggagaaggugcuccagcagcccgccgagaacaucuuuaucgaguucgcccgguccgacgaggagagcaagcgcuccacgccccgggacaaguucaucgagaaggcguacgcccagcugaagaaggagaccgacaccuucaaccuggaacaccucaaggagcugaagcagcgcagcaaacagcugucuucccagcggcuguuccuguacuucauccagaacgggaagugcauguacagcggggaacaccuagacaucgagcgccuggacuccuacgagguggaccacauccugccccagagcuacaucaaggacaacuccaucgagaaccuggcccucgucaagaagguggaaaaccagcgcaagaaggacagccugcuccucaacuccagcaucaucaaccagaauuacuccaggugggagcagcugaagaacgccggccugaucggugagaagaaguuccgcaaccucacccggaccaagauuaccgaccgcgacaaggaaggcuucaucgcccggcaguugguggagacccgccagaucaccaagcacgucacgcagcugcuccagcaggaguacaaggacaccacgaagguguucgcaaucaaagccacccucgugagcggccugcggcgcaaguucgaguucaucaagaaccggaacgucaacgacuaccaccaugcccaggacgccuuccucguggcguuucuggggacgaacaucaccuccaacuacccgaagaucgagauggaguaccuguucaagggcuaccagcacuaccuaaacgaggugggcaagagcgcugccaagcccaaguucaccuucauugucgagaaccuguccaagcagcaguauaacagcaccacgggggaggugaaguggaaccccgagguagauauugccaagcugaagcgcauccucaacuucaagcagugcaacaucguucggaagguggaggagcaguccggggcacuguucaaggagaccaucuaccccguggaggaauccuccagcaagacuaucccgcugaagaagcaccucgacaccgcgaucuacggcggcuauacggccgucaacuacgccagcuacgcacuaauccaguucaagaaggggcgcaagcugaagcgggagaucaucggcaucccccuugccgugcagacccgcaucgacaacuccgagaccagccugcaggcguacaucgccgagcagaucaaguccgagguggagauccugaacgggcggauccucaaguaccagcugaucagcaacaacgggaaccgccuguacaucgccgggcccuccgagcggcacaacgcccgccagcucaucgucagcgacgaggccgcaaagguuaucuggcugauauccacaaagcaggccgacgaggccauguuccugaaguacuaccggcucgaacaccuggaggccguguucgaggaguuaauccgcaagcaggcggccgacuaucagaucuucgagaagcucaucaagaaaauugaggucaacaaaguguacuucuacagcugcacguacaacgagaaggugaaggucaucgaggagcugcugaagaucacccaggccaacgccacgaacggcgaccucaagcugcugaagauguccaaccgggagggcagacucgguagcgugagcguggcccuggacuucaagaucaucaaccagucggucaccggccuguaucaguccaucgaggacuacaacaacuga

SEQ ID NO: 7561 - RNA, 3930 nt, Artificial Sequence
  Cas9 variant
auggguuccguuggcuucgccggaauagacaaucaauacaaccuggugaggacaaaagguaaaaacguaaucggaguacgacuauucgacgaagcggauagcgcagccgaacguagaggccaucgcaccaaccgccgacgccuccaaagaagacgcuggcgauugagacuacuggacgacauauucgcgaagccccuacaagcagucgacccaaacuuccuggcgcgccuaaaauacucguacguaaauaagaaagaccaaggucagcaggaccacuacuacgggggcuacguauucggaagcacagcagcagaccaagccuaucaccaagcauacccaacaauauaccaccuucgcaaaagacucauggaagacgaccaaaaacaugaucuacgugaaguguaccucgcaauccaccacaucguuaaauaccgagggaacuuccuaaacccucaaucgucacuggacaucgaucaacaguucgauguaacugacuucgcccaagcacucgcacgcuucgcagaccaccaagcacuguccugggcacuagaagcacccaucagauuucuugaagccgaacucgccaccggacucuccaacucagcaagaguagacgccgcgauagaggcuuucucauucgacacaaagguagacagggccgcgaucaaggaaaugcucaaaggucucucgggcaaccagaucgacuucacaaaacuguucgugaaugucgacagcgccgauugggaccaagaggaacgcaagcaauggaagaugaagcuauccgaagaagacuucgacgaacaagcgcuacccauccuugagaggcucagccaagacgaaacagaguucuucuuagccaucaagcgggccuacgacgguaucgcacuuaugcgcuuccuaggagacgaacagucacuauccagcgccaugauaaaagcguacgaagaccacagaagagaucuaaccuuccucaaaacccagguucgaacuccccaaaaccgccaagcccugagcgagggcuauacgaacuaccuuucgguugaugacaagaaacacaaaagaggagcgaaagaauuagcccaacucauagaagcguccgaugcgucagaacaagacaaagccaccaugcucgaccggaucgcaaacgaccaauucgcaccuaaacagcgcaccaaagccaacggauuaauuccauaccagcuacaucucgcagaguuaaagaaaauccucgcgaaacaagggcaauacuauccauuccuacuggacacauucgcaaaacaaggccagucaguaaauaaaauugaagaacuuguccaauuuagaguucccuacuacgugggccccauggugccaaaaagcgaaacagcuggcaacgccgaaaaccacugggucgagaaaaacgacggccaaacgaaagucagcgucaccccguggaauuucgaccaaguguucaacagagaccgcgcagccaaaucauucauugaucggcuaaccgggaccgauaccuaucuaaucggggaacccacucuaccgcgucacucccuaacguaugaaacguucaccgugcuaaacgagcucaacaacauacguaucgacgggaaaaggcuccccgucgagaccaagcaggcaaucgucgaggauuuguucaagaaauaccggcucgugaccaagaaaaggcuucaagacuacuucgcgucauucggcaaacgagaaguagaacucacgggucucgcugacgagagcagguucacaaguucccugaccagcuaccacgacuugcaaggucugcugggcacagauuucauaacaaacccacagaaccacagcuuacuggagaaaauagucgaaauucaaacagucuucgaagacagcgacauugcagaacgcgaacucggcaagcuaggacuugaacaaaaacucauaccccgacucgccaagaaacacuacacaggcuggggaaaccucucacgcaaacuccuggacaccuccuucauccaugacccagaaagacccgaagaacccguuaguauuauggaccuacuuuacacaacaaacaaaaacuucauggaaauacugcacgacuccgaauacgggguugaagaauggcuaaaaucccaaaacaugaucgacgaccaaaaagacauccaaaugcgaaucgacgaacuaacaacaucccccgccaacaaacggggcauaaaacaagccuucaacgugcuagacgacauaacccaagccaugggagaagaaccugcuuacgucuaucuggaguucgcaagagaaaaacaggcuucucgccggaccguaucccggaagaaacgccucgagacucucuauaaaaacgcggcccucaaaacagaguuuaaagcaaucaaagaagcacucgccgaagaaagcgacgaccgcaugcaagacgaccgacuuuaccucuacuacgcacagcuuggucgagacauguacaccggccaauccaucucuauagaccaacuaucgucacacuacgacaucgaccacaucgugccccgcgcauucaucaaggacgacagucuagaaaacaaaguccucgucaacaggaccgacaacgcacgaaaaacagauagcgccaccuucacagccgacguaaaagccaaagcauucccgcuuuggcagcaacucaaaaagcucggccuaauuagcgccaagaaauuucgccuauuaacucguacaggggacuucacggaaauggagcgcgaacgguucaucgcccgccagcuaguggagacccgacaaaucaucaaaaauguggccgcacucaucgaaggccacuucucacaaacccaagccguugcaauccgagcggaaguaaccggcgaacuccgccaacuuacccaaauuaaaaaggacagagacauaaacgacuaccaucacgcccaagaugcccuccucguggcaaccgccggaaccuaccuacaccgacacuuccccaaacgcgacgcccgauucaucuacaacgaguucgacuacuacacgcaacacuggcucaaaaaucaaggagaaaaccggcgacgccaccccuacagcuucgucgugggaaccaugagcaaaggcaacgaggacuggacccccgacaaccuaaacuaccuccgcaaaguaaugcaauacaaaaccaugcuaaugacacgaaaaccagucggacccgaaggcgcgcucuacaaagaaacgcucaucgccgcagaccccaagaaaagacuugucggcgccucaaaagaacgacaagacccaaccauauacggaggcuacaccaaagaaagcuccgccuacaugucacuggugcgcgcuggcgggaaaaaucaauugguaaaaauaccaguccgaaucgcaaacgagauucacagcggccaacgaaagcucgacgacuacgugcaagcgaaggugaaaaaguucgaacgcauccuacucccaaaaaucucccuaggccaacugguagaagacgaaggccaacgauucuaccucgcgaccaacgaaaugaaacacaacgcaaagcagcuauggcuagaucagaaaguggucaccaccuacaaaaggcuaacagccgagagcccgguugaagacuuucucacugucuucgacgcacucacuagcucagccaccauacaccacuucaaauucuaccagcgggaucucgaacuucuacgugacaaccgggcaggcuuccaggaccuggcaaaagccacacagcucaagguacucaaggacguacuuuacgaacuccacgacaacgcaggcuggagagaccccauaaaacaauacuuuaaagaaauaggccucaagguucguauguggacuaaacugcaaaaagaaggcggaauuaaacucacagaccaagcagaacugaucuaccaauccccaucgggacuauucgagaaacggagacggguacaagaccuacuauga

SEQ ID NO: 7562 - RNA, 3939 nt, Artificial Sequence
  Cas9 variant
augcagaacggcuuccuggggaucacggugagcucggagcaggucggcugggccgugaccaaccccaaguacgagcucgagcgcgccagccggaaagaccuguggggcgugcgccuguucgacaaggcggagacggccgaggaccggcgcauguuccggaccaaccgccggcucaaccagcgcaagaagaaccggauccacuaccugcgggacaucuuccacgaggaggucaaccagaaggacccgaacuucuuucagcagcuggacgaguccaacuucugcgaggacgaccggaccguggaguuuaacuucgacaccaaccucuacaagaaccaguuccccacgguguaccaccuccgcaaguaccugauggagaccaaggacaagcccgacauccggcucgucuaccuggccuucagcaaguucaugaagaaccgcgggcacuuccuauacaaggggaaccucggcgaggugauggacuucgagaacuccaugaagggcuucugcgagagccuggagaaguucaacaucgacuuccccacccuguccgacgagcaggucaaggaggugcgggacauccucugcgaccacaagaucgccaagaccgugaagaagaagaacaucaucacuaucaccaaggucaagagcaagacggccaaggcguggaucgggcuguucugcggcugcuccgugccggugaaggugcuguuccaggacaucgacgaggagaucguaaccgaccccgagaagaucagcuucgaggacgccuccuacgacgacuacaucgccaacaucgagaagggggugggcaucuacuacgaggccaucgugagcgcgaagaugcuguucgacugguccaucaugaacgagauccugggggaccaccagcugcucagcgacgccaugaucgccgaguacaacaagcaccacgacgacuuaaagcgccugcagaagaucaucaaaggcacgggcucccgggagcucuaccaggacaucuucauaaacgacgucagcgggaacuacgugugcuacgugggucacgccaagaccauguccagcgccgaccagaagcaguucuacaccuucuuaaagaaccgccugaagaacgucaacgggaucuccagcgaggacgcggaguggaucgacaccgagaucaagaacggcacgcuccugcccaagcagaccaagcgggacaacagcgugauuccccaccagcugcagcuccgcgaguucgagcugauccuggacaacaugcaggagauguacccguuccucaaggagaaccgggagaagcugcugaagauuuucaacuucgugauccccuacuacgucggcccccucaagggggugguccgcaagggcgagucuacaaacuggauggugcccaagaaggacggggugauccacccguggaacuucgacgagauggucgacaaggaggccagcgccgagugcuucaucucccgcaugaccggcaacugcagcuaccuguucaaugagaaggugcugcccaagaacucccuccuguacgagacuuucgaggugcugaacgagcucaacccccugaagaucaacggggagcccaucagcgucgagcugaagcagcggauauacgagcagcuguuccugaccggcaagaaggugaccaagaagucccugaccaaauaccucaucaagaacggcuacgacgaggacaucgagcugagcgggaucgacaacgaguuccacuccaacuuaaagagccacaucgacuucgaggacuacgacaaccugagcgacgaggagguggagcgcaucauccuccggauaacggucuucgaggacaagcagcugcugaaggacuaccucaaccgcgaguucgugaagcucagcgaagacgagcggaagcagaucugcuccuuaagcuacaagggcugggggaaccucuccgagauguugcugaacggcaucaccgugaccgacagcaacggggucgagguguccgugauggacaugcucuggaacaccaaccugaaccugaugcagauucucucuaagaaguacggcuacaaggcggaaaucgagcgcuacaacaaagagcacgagaaaaacaucuacaaccgggaggaccugauggacuaccugaacaucccgccagcccagcgccggaaggucaaucagcucaucacgaucgugaagucccugaagaagcgcugcggcgugcccaacaagaucuucuucaaggucagccgggagcaccaggaugaccccaagcgcaccagcuccagaaaggagcagcugaaguaccucuacaagagccugaaguccgaggacgagaagcaccugaugaaggagcucgacgagcugaacgggcacgagcugagcaacgacaagguguaccucuauuuccugcagaagggccgcugcaucuacuccgggaagaagcugaaccucagccggcugcgcaaguccaacuaccagaacgacaucgacuacaucuacccgcugagcgcggucaacgaccguuccaugaacaacaagguccucaccggcauccaagagaaccgcgccgacaaguacacuuacuuccccguggaccccgagauccagaagaagaugaagggguucuggauggagcuggugcugcaaggcuucaugagcaaggagaaguacuuccggcucucccgcgagaacgacuucagcgaaaacgagcuggucuccuucaucgagagggagaucagugacaaccagcaguccggcagaaugaucgccagcguacugcaguacuacuuccccgaguccaagaucguguucgucaaggagaagcucaucagcagcuucaagcgcgacuuccaccugaucuccagcuacgggcacaaccaccuccaggccgccaaggacgcguacaucacgaucgucgugggcaacgucuaccacaccaaguucaccauggacccggccaucuacuucaagaaccacaagcggaaggacuacgaccucaaccgccuguuucuggagaacaucucccgggacgggcagaucgccugggagagcggccccuacggcuccauucagaccguacgcaaggaguacgcccagaaccacaucgccgugacgaagcgggucguggaggugaagggcggccucuucaagcagaugccccugaagaaggggcacggggaguacccccugaagaccaacgacccgcgcuucgggaacaucgcgcaguacggcggcuacaccaacgucaccgggagcuacuucgugcucguggaguccauggagaagggcaagaagcggaucagccuggaauacguccccguguaccugcacgagaggcucgaggacgaccccgggcacaagcugcugaaggaguaccucguggaccaccggaagcugaaucacccgaagauccugcucgccaagguccgcaagaacucccugcugaagaucgacggcuucuacuaccggcucaacgggcgcagcggcaacgcgcugauccugaccaacgccguggagcucaucauggacgacuggcaaacgaagaccgcgaacaagauuuccggcuacaugaagcggcgcgcuaucgauaagaaggcccggguguaccagaacgaguuccacauccaggagcuggaacagcuguacgacuucuaccucgacaagcuggaaaacggggucuacaagaaccguaagaacaaccaggccgagcugauccacaacgagaaggagcaguucauggagcucaagaccgaggaccagugcgugcuguugaccgagauaaagaagcuguucgugugcagcccuaugcaggccgaccugacgcugaucggcggguccaagcacacaggcaugauagcgaugagcuccaacgucaccaaggccgauuucagcaucaucgccgaggacccccucgggcugcggaacaagguuaucuacucccacaugggcgagaaguga

SEQ ID NO: 7563 - RNA, 3939 nt, Artificial Sequence; identical to SEQ ID NO: 1763
  Cas9 variant

SEQ ID NO: 7564 - RNA, 3942 nt, Artificial Sequence
  Cas9 variant
augcacuaccuggacgagaucuucgcgccccaccuccaggagguggacgagaacuuccugcgccggcugaagcagagcaacauccacccggaggaccccgccaagaaccaggccuucaucggcaagcuccuguuccccgaccuucucaagaagaacgaacgcggguaccccacccugaucaagaugcgggacgaguugccagucgagcagagagcccauuaccccgugaccaacauuuacaaguuacgggaagccaugaucaacgaggaccgccaguucgaccugcgggagguguaucuggccguccaccacaucaugaaauaccgcggccacuuucuuaacaacgccuccguggacaaguucaagguggggcggaucgacuucuacaagagcuucaacguacuuaaugaggcguacgaggagcugcagaacggcgagggcuccuucacgaucgagcccagcaagguggagaagaucggccagcuccugcuggauaccaaaaugcgcaagcucaaucggcaaaaggccguggccaaacugcuggaggucaagguggccgacaaagaggagaccaagcgcaacaagcaaaucgcgaccgccauguccaagcucguguuaggcuacaaggccgacuucgccacagucgccauggcgaacggcaacgaguggaagaucgaccuuagcuccgagaccagcgaggacgagaucgagaaguuccgggaggagcucucugacgcccagaacgacauccugaccgagaucaccagccuguucucccagauaaugcucaacgagauugugcccaauggcaugagcaucuccgaaagcaugauggaccgcuacuggacgcacgagcggcagcuggccgaggugaaagaguaucuggccacccagccggccuccgcgcgcaaggaguucgaccaggucuacaacaaguacaucgggcaagcccccaaggagcggggcuucgaccucgagaaggggcugaagaagauccugagcaagaaggagaacuggaaggagaucgacgagcuccugaaggccggcgauuuccugcccaagcagcgcaccuccgccaacggcgugaucccccaccagaugcaccagcaggagcuugaucggaucaucgagaaacaggccaaguacuauccuuggcuggcgaccgagaaccccgccacgggggagcgagaccggcaccaggccaaguacgagcucgaccagcucgucagcuuucgaauccccuacuacguaggcccucuggugaccccggaggugcagaaggccaccuccggggccaaguucgcgugggccaagcguaaggaagacggcgagaucacccccuggaaccugugggacaagaucgaccgggccgagagcgccgaggcguucaucaagcggaugacgguaaaggacaccuacuuauugaacgaggacgugcugcccgccaacagccuccuguaccagaaguacaaugugcugaacgagcucaacaauguccgcgugaacggccgccggcugucaguaggcaucaagcaggacaucuacaccgaguuguucaagaagaagaagaccguaaaggugagcgacguugccagucuggugauggccaaaacgcgcggcgugaacaagcccagcgucgaggggcucuccgacccgaagaaguucaacagcaaccuggccaccuaccuggaccucaaauccaucgugggcgacaagguggaugacaaccgguaccagaccgaccuggagaacaucaucgaguggagaagcgucuucgaggacggggagaucuucgcggauaaacuuaccgagguggaguggcucacugaccagcagcgguccgcccuggugaagaagcgcuacaagggcuggggccggcugagcaagaagcuccugaccgggauugucgacgagaacggccagcgcauaaucgaccugauguggaacaccgaccagaacuucaugcagaucgugaaccagcccguguucaaggagcagaucgaccagcucaaccagaaggccaucacaaacgaugggaugacgcugcgggaaugggucgaguccgugcuggacggcgccuacaccucgccccaaaacaagaaggccaucuggcaggucgugcgcguaguugaggacaucgucaaggcgguggggaaugcgcccaaguccauuucaaucgaguucgcacggaacgaaggcaacaagggcgagaucacccgaucccggcgcacccagcuccagaagcuguucgaggaccaggcccacgagcuggugaaggauacgagccucaccgaggagcuggaaaaggcuccggacuuguccgaccgguacuaccucuacuucacccaaggcggcaaggacauguacaccggggaccccaucaacuucgaugagaucagcacgaaguacgacaucgaccacauccugccccaguccuucgucaaggacgacagccuggacaaccgugugcucguuucaagggcagagaacaacaagaaguccgaccggguccccgccaagcuguacgccgccaagaugaagccguacuggaaccagcuucucaagcaaggccugauuacccagcgcaaguucgagaaccugaccauggacguggaccagaacaucaaauaucggagccucggguucgugaagcgccagcuggucgaaacccgccaggugaucaagcugaccgcaaacauccucggcuccauguaccaggaggccggcacagacaucaucgagacccgggccgggcugaccaagcagcuacgggaggaguucgaccuccccaagguccgcgaggugaacgacuaccaucacgcuguugacgccuaccugaccacguucgcgggccaguaccugaaccggcgcuaccccaagcuccggagcuucuucguguacggggaguacaugaaguucaagcacggcuccgaucugaagcugcgcaacuucaacuucuuccacgagcucauggagggcgacaagagccaggggaaggucguggaccagcagaccggcgagcugaucaccacccgggacgagguagccaaguccuucgaccgccuguuaaacaugaaguacaugcuggucagcaaggagguucacgaccgguccgaccagcucuauggggccacgaucgugaccgccaaggagagcggcaagcucaccuccccgaucgagaucaagaagaagcgccccgucgaccuguacggugccuauaccaacggcacgagcgcguucaugaccaucaucaaguucaccggcaacaagcccaaguacaaggugaucgggguucccaccacguccgccgugggcuuaaagcggguggggaagccgggcuccgagucguacaaccaggagcuccaccgcaucaucaagagcaaccccaaggugaagaaggacuuugagauugucgugccccauguguccuacagucagcugaucgucgacgacgacugcaaguucacccuggccagcgacaccuaccagcaccccgccacccagcuuguacuguccaaggagucgauggagaucaucgcagacgacuucaaauucguuaaggagaacacggcgaccgccgacgagcagcuggugcggguuuucgacgagauugugaaccagaugaaccacuacuucaccauauucgaccaacgcuccaaccggcagaaggugaccaaggcccgcgacaaguucgugagccucccgacggaguccgaguacgagggggccaaaaagacccaggucggcaagaccgaggugaucacaaaccugcugaugggccuccacgcgaacagcgcccagggggacuuaaagguacugggcuuguccacguucggguucuuccagagcuccggcgggcugaaccugagcgaggacgccaugaucgucuaccagucccccaccggccucuucgagcgccggaucugccugaaggacaucuga

SEQ ID NO: 7565 - RNA, 3942 nt, Artificial Sequence; identical to SEQ ID NO: 1765
  Cas9 variant

SEQ ID NO: 7566 - RNA, 3945 nt, Artificial Sequence
  Cas9 variant
augcugaagaaggacuacagcaucggccucgauaucgggaccaacuccgugggccacgcugucgugaccgacgacuacaagguucccacgaagaagaugaaggucuucggggacaccagcaagaagaccaucaagaagaacaugcugggggugcuccucuucaacgagggacagacagcggcggacaccagacugaagcggggcgcccgccggcgauacacccggcgcaagaaccggcugcgcuaccuccaggagaucuucgccccggcccuagccaagguggaccccaacuucuucuaucggcuugaggaguccagccucgucgcggaggacaagaaguacgauguguacccgaucuucggcaagcgcgaggaggagcugcuauaccacgacacccacaagaccaucuaccaccuccgguccgagcuagccaauaacgaccgccccgccgaccugcggcucguguaccuggcacuggcgcacauuaucaaguaccgcgggaacuuccuccuggagggcgagaucgaccugcggacuacagauaucaacaaggucuucgccgaguucagcgagacccucaacgagaacuccgacgagaaccuggggaagcuggacguugccgacauauuuaaggacaacaccuucagcaagacgaagaaguccgaggagcuccugaagcugagcggcgccaagaaaaaccagcucgcccaccagcuguucaagaugaugguggggaacaugggcuccuucaagaagguacugggcaccgacgaggagcacaagcucagcuuugggaaagacaccuacgaggacgaccugaacgaccugcucgcggaggccggggaccaguaccuggacaucuucguggccgccaagaagguguacgacgccgcgauccuggccuccauccucgacgucaaggacacccagacgaagaccguuuucagccaggccaugaucgagcgcuacgaggagcaccagaaggaccugaucgaacugaaaaggguguucaagaaguaccucccggaaaagugccacgacuucuucuccgagccaaagaucucgggguacgcuggcuacaucgacggcaagguuuccgaggaggacuucuauaaguacacgaagaagacccugaaggggauccccgagacggaggagauccugcagaagaucgacgccaacaacuaccuccgcaagcaacggaccuucgacaacggcgcaaucccccaccaggugcaccugaaggagcugguggccaucgucgagaaccaagggaaguacuacccguuccuccgcgagaacaaggacaaguucgagaagauccuuaacuuccggauccccuacuacgugggcccccuggcccgcgggaauagcaaguucgccuggcucacccgcgccggagagggcaagaucacccccuacaacuucgacgaaaugaucgacaaggagaccagcgcggaagacuucaucaagcggaugacaaucaacgaccuguaccugccgaccgagcccgugcugcccaagcacagccuccuguaugagagguacaccaucuucaacgagcuggccggugugcgguacgugacggagaauggcgaggcgaaguacuucgacgcccagaccaagcgcagcaucuucgagcuguucaaguuggaccguaaggucuccgagaagaugguuaucaagcacuuaaagguggucaugcccgcgauccgcauacaggcccucaaggggcuggacaacggcaaguucaacgccagcuacgggaccuauaaggaccugguggauaugggcguggccccggagcucuugaacgaugagguuaacuccgaaaagugggaggacaucaucaagaccuugacgaucuucgagggcaggaagcucaucaagcgccggcuggagaacuaccgcgacuuccugggggaggacauccuccggaagcugagccgcaaaaaguacaccggcuggggacggcugagcgccaagcuccuggacggcaucuacgacaagaagacccacaaaaccauccuggacugccucaugacggaggacuacagccagaacuucaugcaacugaucaacgacgacaccuacuccuucaaggagaccaucaagaacgcccaggugaucgagaaggaggaaacccuggccaagaccgugcaggagcuccccgggucacccgccaucaagaagggcauccugcagucccuggagaucgucgacgagaucaucaaggugaugggguacaagcccaaguccaucgugguugagauggcccgcgagacgcagaagacucacgggacccggaagcgggaggaccgggugcagcagaucgugaaaaaccucaaggacgcaaacgagcugccgaagaagcugcccuccaacgcggagcuaucggacgagcgcaaguaccuguacugccugcagaauggccgcgacauguacaccggggcgccccucgacuaugaccaccuccaguucuacgacgucgaccacaucaucccccaguccuuccugaaggacgacagcaucgaaaacaaggugcugacgaucaagaaagagaacgugcgcaagaccaacggccugccguccgaggccgucauccagaagaugggcagcuucuggaagaagcugcucgacgccggugccaugaccaauaagaaguacgacaacuugcgccggaaccugcacggcgggcucaacgagaagcugaaggagcgcuucaucgagcggcagcugguggagacccgccagaucacgaaguacguggcgcagcuccuggaccagcggcugaacuacgacggcaacgggguggagcucgacgaaaagaucgccaucgugacccugaaggcccagcuggccucccaauuccgaagcgaguucaagcuccggaaggugcgcgcgcugaacaaccugcaccacgcccacgacgccuaccucaacgccguuguggccaaccugaucauggcgaaguaccccgaauuggagcccgaguucguguacggcaaguaccggaagaccaaguucaagggccucgggaaggccaccgccaagaacacgcuguacgccaacguccuuuacuuccucaaggagaacgagguguaccccuucugggacaaggccagggaccugccgacgaucaagcgguaccuguaucgagcccaggugaacaagguccggaaggcggagcgccagacgggcggguucuccgacgagaugcucgugcccaaaagugacagcggcaagcugcugccacggaaggagggccucgacccggucaaguacggcggcuaugccaaggcagucgaguccuacgccgugcucaucaccgcggacgaagugaagaaggggaagacgaaaaaggucaagacccuggugaacauccccaucauugacagcaagaaguacgaggccgaccccacagccuaccucgccucccgcggcuacaccaacgugacgaacagcuucauccugccuaaguacucccugcucgaggacccggaggggaggcgccgguaccuggcgagcuucaaggaguuccagaaggccaacgagcugauccucccgcagcaccuggucgagcuacuguacugggugaacgccaaggauggcgagcagaagcuggaggaccauaaagccgaguucaaggagcuguucgacaagaucauggaguucgccgacaaguacguggucgcgcccaagaacucugagaagauccgccgccucuacgaggagaaucaggacgccacccccauggagcuggggaagaacuuuguggagcugcuccgcuacaccgccgacggggccgccagcgacuucaaguucuucggcgagaacaucccgcgcaagcgguacaacuccgcggguagccugcugaacggcacucucaucuaccaauccaagacggggcuguacgagacccgaaucgaccugggcaagcucuga

SEQ ID NO: 7567 - RNA, 3948 nt, Artificial Sequence
  Cas9 variant
augggcuacagcguggggcuggacaucggcaccggguccgucggcuggguugugacaaacgaggacgggaagcucgcccgcgccaagggcaagaaccugaucggcguccggcuguucaagacggcggagcccgccgccgacaggcggaccaaccgcaccacccggcgccggcucagccgccggaaguggcgccugcggcugcucgaugagcuguucgccaacgagcuggggaagaucgacuccaacuuccucacgcgcuugaaguacagcuacgugcauccgaaggacgacgccaaccgggcgaacuacuacggcggguaccuguucccaacccaggaggagaccaaaaaguuccacgccaaguaccccacgaucuaccaccuccgccuggcccugaugacggagucccggcaguucgaccuccgggagaucuaccuggccaugcaccagaucgucaaguaccgggggcacuuccuuaacucacaguccaagaugaccaucgggaacaccuauaacccccaggaccuccagaccgcgauggagaacuacgccgaggccaagggccugagcaucgagcugaagcagccggaggagauggucgccauccucacgggcgaggccggguucggccuguccaagaaagcuaaggccgagaagcugcucaacaacuucuucuucgacaccaaggaggagaaggccacugugcaagccauucuggccgggaucgugggcaacaccaucgacuucacgaaggucuucaaccgccagcugaccggcgacacccucaaggcguggaagcugaagcuggacagcgagaccuucgacguggacuccgagcccauccucagcgaccuggaugacgacgagacggagcuguucuucgccauccggcaggccuucgacggguucacccucaugaaccugcugggcgaccagacuuccaucagcgccgccaugguggagcgcuacacccagcaccacgacgaccuccugacggucaagcaggucgcgaagaagcaggggcugucccacaaggaguucagcaacaucuacuccgccuuccucaaggacgacaccgacaagggcaugaagaagcugcuggaggagagcaaccucuccaccgaggacgugaacgggauccaacugcggauggacagccacgacuuccugccccagcagcgcaccaaggccaacagcgugaucccccaccagcuccaccucgccgagcuggaggccaucaucgagaaccagggccaguacuacccguuccugcuggagacguucgaaaaggagggcaccgcggccaacaagaucgccgagcugcugaaguuccgcauccccuacuacguggggcccauggugaccaagaaggacgucgagaacgccggcggggacgcgaccaaccacugggugacccggaacgagggcuacgagaaguccgccgugaccgccuggaacuucgaccaggucuucaaccgagaccaggccgcccucgacuucauccaacggcugaccgggaccgacacguaccugaucggcgagcccacccucccgcagaacagccugaaauaccagauguucaccgugcugaacgagcucaacaaugugaaggucaacggccgccggaucgacaaccagaccaagcacgacuugauccaggaccuguucaaguccaagaaaaccgugagccucaaggcguuccaggauuacuaccagucccagggcaagagcgacauccaggucguggggcuggccgacaagacgaaguucaacuccaaccugagcaccuacaucgaccucuccaagacuuucagcgccgaggagauggagaacccacagaaccaggaccugcuggagcagaucguggagauccagaccgucuucgaggacuccaagaucgccgagcgcgaacucagcaagcuggagcugacgcccgaacaggucaccaagcucgccaagacccacuacacuggguggggcaaccuauccaacaagcugcucacgaccccgauaguggacgugagcggaaagaagguuuccauccuggaccagcuggcgaagaccagcaagaacuucauguccaucaucagcaacgagcaguacggcgugcaggacuggaucaaggagcagaacaccacggagaccaccggcacccucgaggacaagcuggccgaccugacgaccuccccggccaauaagcgggggaucaagcaggccuucaacguccuauucgacauccagaaggccaugaaguccgaacccgaccgcguguaccuggaguucgcucgggagacccagaccagcgugcgcacgaugagccgguacaacuaccugaagggccucuaccagagcaagucccuggacgccgaggccaagaaccugaagaaggagcucgccgagaccgaccagaagaaguucgacaacgaccgccuguaucucuacuuccagcagcaggggaaggacauguacaccggccagcccaucaacaucgacaagcucagcuccgacuacgacaucgaccacauaaucccccaggcguucaccaaggacgacagcaucgacaaccggguccuggugucccgcccggagaacgcccgcaagagcgacuccgggacguacaccacggaggugcaggccgccgccagcgggcuguggaagacccucguccaguccggcuucaucagccggaaaaaguacgaccggcugacgcacgcgggggacuacuccgaaggccagaagaccggguucaucgcucgccagcugguggagacccggcagaucaucaaaaacguggccgcccuaaucgagagcgaguucgaccagacgcaagcugucgcgauccgcgccgaaaucacuggcgacaugcgacggcugguggccaucaagaaacaccgcgagaucaacuccuuccaccacgccuucgacgcccugcucaucaccgcggccggccaguacaugcagaagcgguaccccgaccgcgacagcaacaacguguacaacgaguucgaccgguauaccaacgacuaccugaagaagcugcgggaguccagcagcaaggacgagguccggaaacugaagcccuucggguucaucgugggcaccauggccaaggggaacgaggacuggacgaccgagcagaccgaguaccugcgccacaucaugaacuucaagaacauccugaccaccuacaagacggggcccgaccgggggccgcucuccaaggagaccaucuacgccguggaccccaaggcgaagcugaucggcaccaacaagcaccgccaggacgucagccuguacggcggguacacuuaccccuacagugccuauaugacgcucgugcgggccaacggcaaaaaccagcuggugaaggucagccgcuccgccgccagccugaugaaguccgggcagcucaaacuggaggacuacgugcagcagcagcccgaggugaagaaguucgagaagauccugcucgagcaccucccgcugggccagcuggucgacaacgacgggaagcugauguaccugaccagcuacgaguucuaccacaacgcgaagcagcucuggcuguccaccgagaacgccgaccugaucagcucccucagcaucgacuccgacgaccagaagcugaucaaggccuucgacauccugaccgccgacagcgugaucgagcgguuccccuucuacgagaucgaccucaagaagcugaucgagcuucgcgacaaguucgugcucaucgacaacaagcuggacguccugcggguagugcucaaggcccugcagcuggacuccgcgcagcagaagccgcucaagcugauagacaaggccgccacggacuggaagaacuaccgccaggccggcggcaucaagcugagcgacaacgccgagaucaucuaccaguccaccaccgggaucuucgagaagcggaucaagaucagcgaucuccuguga

SEQ ID NO: 7568 - RNA, 3951 nt, Artificial Sequence
  Cas9 variant
augcugcaaaagaacuacacgaucggccucgacaucgggaccaacagcguaggcuaugccgugaucaacgacaacuacaaaguccccgccaaaaagaugaaggugcuggggaacacggacaagaagaccaucaagaagaaccugaugggcguccuccuguucgacgcgggggagacggccgccaccacccgccuaaagcggggaacccgacggcgguacacccggcgccggaaccgccuccgcuaccugcaggaaaucuuagggccggagcuggccaagguggacgccaacuuccuccaccgccuggcggagaguagccucgugacugaggacaaggaguuuuccgccuacccaauauucggagaccgggaggaggagcugcuguaccacaagacauacaagaccaucuaucaccuccgcagcgcccuggccaacaaggacgagaaggcggaccugcggcucauauaccuggcccuggcccacaucaucaaguaccgcggcaacuuccucaucgagggggagaucgagcuguccgacaccgauaucgacaagguguacgccgacuucugccggagcuucaaugagcuguucgacaccgaggugcuccaggagaucgagguggaggcuaucuucaaagacaagacgcuguccaagacuaagaaagcggaggaacuggucaaggugagcggcgugaagaagaaccagguugcccaccaguucuugaagaugaugguggggaacaccgugaacuucaagaaggucuucaaccugaccgaggaccagaagcugucauucggcacggacagcuacgaagaugaguuaaaugaccugcuggccaaguccgacgaccguuaucucgacguguucguggccgccaagaaggucuacgacacggcgauucuggccaacauccugaacaccaaaaauucgguggccaccaagacgaucuucucccagagcaugaucgagcgguucaaggaccaccagaaggaccucaaggagcugaagcagcuguucaagaccuaucuccccgagaaguacccggauuucuucggcaacuccaaggaggacggguacgccggcuacaucgaggggaagaccaacgaggagaaauucuacacccacacgaagaagaucuuaaagaacaucccgcaggcggcgagcgugcuggcucagaucgacgucggcaacuacuugcggaagcagagaaccuuugacaacggcgugaucccucaccagauacagcugaaagagcugcucgccaucaucgagaaccaggggaaauacuaucccuuccugcuggagaacaaggagaagauugccaagauccucaccuuccgcauccccuacuacgugggcccgcuggcccgggggaacucaagauucgcguggcugaagagagucggcaaggagaagaucacccccuucaacuuugagaacgugguagaccuggagagcucagccgagcgguucaucgagcguaugacgcucaacgaucuguaccugcccgaggagaaggugcuccccaagcacaguauguuauacgagaaguuuagcauauucaacgagcuggccggcauccgguacauuaccgacaacggcgagaugaaguuccuggacgcgcaaaccaagcaguccaucuucgagcuguucaagcaggagcgcaccgugaaggagaagaagguccuggaccuccugaagacgcugaugccgucugagcgggugguggcgaucaagggcaucgacaacgggaaguucaacgccuccuuuggcaccuaccacgacuugagcaagaugggguucaagaccgagaaaauagccuccgaaagcaaucaggcgcgcugggaggagaucaucaagacccugacgaucuucgaggaccggaagcugaucaagucccgccucagaaaguacgacgacuuccugaacgagaaggagauuggcgcccuguccaaacgcaaguacaccggguggggccggcucuccgcuaaguuaaucgacggcaucuacgacaagaagacccaccaaacuauccuggacuucuugaugaaugaggacuacaaccaaaacuucaugcagcugaucagcaacgacaacuacuccuucaaaaagaucaucgaggacagccaggucaucaaggaggaggggagccugaccgaggugauccaggagcuccccggcagccccgccaucaagaaggggauccuacagucgaucgagauaguagacgaacuugucaaggugaugggcgggaacccgaagaaaaucguggucgagauggcgcgcgagacgcagaagacccacggcacuacccggcgcgaggcccggaucaaggagaucaucaagaaccucaauaagcugaagcugaacgagcuuccgaaggaccuacccagcaaugaggaguuguccgaugagaagguguaccucuacugccugcagaacggccgcgacauguacacgggggcuccccuggaccucgacaaccugagccaguacgagguggaccacaucaucccccaaucauuccugaaagacgacuccaucgagaacaagguccucaccgccaagaucgagaacagccggaaaacgaauggccugccgucaguagagaucgcgaagaagaugggagccuuuuggcgcagccuccucaaggugggcgccaucuccgagaagaaguacaggaaccugcgccgcagucugcacggcgggaugaccgagaagcucaaagaaacguuuguaaagcggcagcugguggagacccgccagauuaccaaguacguggcacagauccugaacucgcgcuucaacgaagagaaaaacgaggacaaggucgcaaucgugacuuuaaaggcccagcugaccagccaauuccgcaaggacuucgagcuguacaaagugcgggagaucaacaaccuccaccacgcccaugacgccuaccucaacgcggucuuagccacccuccugaugaccuccuuucccgagcuggaacccgaguuuguguacggcaaguaccgcaagacuaaguucaaggggcucggcaaggcaacggccaagaacaauuuauacaccaacauacugcagcuccugaaggaggagagcgcacaguacugggacaccaaggagcgcgaccuggcgaccaucaagaagaacguguaccaggcccaggucaacaaggugcgcaaggucgagcggcagacuggguccuucuacgacgagaccgucgccaagaaauccgccagccagaagcuauucccccgcaagaacggccuggaccccgugaaauacggcggguaccaacgcgccaacgagggauacagccuccucuuccgcgcggacaugcugaacaagcgggggaagaccaaauccgugaagacccuggucaaaaucccgaucaucgagagcgcccaguaccucgccgauccgacggaguaccuggccaagcgcggcuacuauaacguguccgagcauagccuguuacugcccaaauucucacugcucgagaacaacaacggccugcggcgcuaccuggcgucuagcaacgaguuccagaaggcgaacgagcucauccugccgaagcaccuggugcggcuccuguacuggucccagucgaagcagcgcaaggaggagcugaacaagcaccgggccgaguucgccgagcuguucaccuauaucauggacuucgccgacaaguaugucguggcgcccaaaaacuccgagaagauuaagaacaucuacgagaacaacaaagacagcuccguggagguccugggaaagaacuuuaucgagcuucucaaguacaccgccgacggcgccgccagcgacuucacuuucuucgacacgaaaaucccccgcaagcgguacaacuccgccggggaccugcuggacggcacacuaauauaccagagcaagaccgggcuguacgaaacccgcaucgaccugggcgcgauauga

SEQ ID NO: 7569 - RNA, 3957 nt, Artificial Sequence
  Cas9 variant
augaugaucaagcugaacaacaugaaaaagauccucggccuggaccuggggaccaacagcaucggcugggcgguggucgagacugaagacaacaagaaguucgagcuccuggacaagggggugcgcaucuuccaggagggcgugaagaucgagaaggggaucgaguccagcaaggccgcggagcggacgggcuaccgcuccgcccggcgcaucaaguuccggcgccggcugcgcaagauugagacccucaaaguccugaucgagaacaacaugugcccccugagcauggacgagcucauuguguggaaggagaacaagaacaacuacccgaagaacaagaucuucuacaacuggcugaagaccaaggaccccaaggagggcaccaacgggacguacaucaaccccuacuacuuccggaccgaagccaucaagcgcaagcuggagaacaccaacgacgugggccgggcccucuaccaccuggcccagcgccggggguucaaguccaacaggcuggagagcaccgacgagaagucccggggcaucgucaagacggaaaucaacaagcucagcucggagcugaacggucgcuaccugggcgaguacuuuuacgagcucuaccugaagggcgagaagauccggaagcgccacaucagccgggaggagcacuaccugaacgaguuuaagaagaucugcgaggugcaaaacuucaacaaagagcucgcggagaagcucgagcgcgcuaucuucuaccagcggccccugaagucccagaaagggcucgugggcaagugcacccugcagaacaacaagcaccgcugcccgaucagccgccccgaguucgaggaguuccggauguggcaguucaucaacuccaucaaguacaagaacagcgacgggaaguucgacuuccugaacaaggagcagcgcgagaacaucauaccggccuucgucuccaacaagaacgcaaccuucgaguucagcaagaucgagaagauccucaacaagggcgugcacaucuaccaguuuaacuacaaguccaaccacaccaucggcagcaaccagacaaugaucaacuucauggacguguucgacaucgaccggaagcugaccaacgcguggcugcucugcgucaacaagaucuacgagcuguacaccgccaagaccaagaaggacgggucccucaagagcaagagcgaagugaucacggacguguggcacguccuguucaccuucgacaacgaggagaaccugaaggaguucgcccgcaacaagcugcuccuggacgaguccagcgcccagaaauucuccaagaucaaccugaagcaggacuacagccagcuaucucugaaggccaucaacaagauccugcccuaccuccaggagggccugaucuacagcuacgcgguguucaucgccaacaucgagaacgugaucgggaaguccaucuggaacauuaaggagaaccagcagauuauccggaccagcauaaagaagaucaucgacaaccacaagaccgagcuggacaucaacacgaucaccaacucccucaucaacgacuucaaggucaacuacaacaacgcccacaaggaguacaagguggacgacaucgaccugaagaacauccgcgagaagaucaucaaguacuacggaaacaagaccuggaauugccugccggaggacgagaagcucuacgugaaggagaaggucgagaagcuguacgaaaagcagcucaagagcgggaagcggggcaucuucaucgagaagauccgccuggacgaccggaucgagaauuuccugaaggacaacuuugacuccagcgagcugaaccugaagaagcucuaccaccccuccgacguaucaguguacaaguccgucaagaucaccgaccugggccugcgccuccuggggagccccaugauccccuccaucaagaacccgauggccaugcgggcuaugcaccagcugcgcaagcucaucaaccaccugaucaucgagggcgugauugacgacagcacgaucaucaacgucgagaugucccgggagcugaacgacgcgaacaugaggaaggccaucgagagguaccagcgccagcgggcuaccgagaacgaggaguucaagaccaagaucaaggaacucuacaagaaagagugcgggaccgacuucgagcccaacaaugacgacaucaugaaguaccgccugugggaggagcagaaucacaaaugccuguacacgggcaagagcaucgggaucugcgacuucaucggcagcaaccccgccuucgaaaucgagcacaccaucccccggucccucagcuacgacaacucgcuggagaacaagacccugugcgagaaggaguucaaccagcaggucaagaagaaccgcaucccguucgagcucagcaacuacaaagagaucaucucccgcaucaacaacugggagaucaaggccgaggagcuguucaagcagauccagaaggugaagauccagagccggauggcggccaccaaagagaucaaggacaacgccauccagcgcaagcaccuccugcagauggaguucaacuacuggaacgggaagcugucccgguucacgcgcgaggacgugcccgagggguucaagaacagccagcugguggacauaggcaucaucaccaaguacgcccgggcuuaccuuaagaccguguucaacaacgucaacaccgugaagggguccacgguggcggaguuccgcaacaucuggggccugcaggaguacuuugagaagaaagaccggagcaaccacauccaccacugcaucgacgccaucaccaucgcgugccugaccaaagacaaauacgacuuccucgcucaccuguaccaccuggacgagcagaacaaucgugacgcgguccaccgggccaugaucaaguccaagcccugggagaacuucgugcaggacgugaaagagaucgagaaccagauccucgucagccacuacacccccgacaaccugccgaagcaguccaagaagauccugcgcaagcgggggaagauccagaagaacgagaacggcgaccucaucuacgagaagggcgacgccgugcgcgggucacugcacaaggaguccuucuacggcgccaucaagcgggagaucaucaacaagaagggggagaccgaggagaaggugcuuuacgucaagcgcaagccccucgaguucagcgaccugggcuucaagacgaucuccgagcuggagaacauaguggacgacgccgugcgggacaagguccucaacgcggugaaggacaagggccugaagcaggcccugaacgagcccaucuggaugaacgaggagaagcagauccccaucaagaaggugcgcugcuacaccccgagcgucaccaaccccaucaaccucaagaagcaccgggacaagagcaaacacgaguacaagcaguccuaccacgucaccaacgacgggaacuaccugauggugaucuacgagggcaaggacagccaggagaaggucaagcgcgacuacgaaaucguguccaaccugcaggccggggaguacuucaagcagagcgugcacggcguccuaaaagcccaggggaucaauaaccuggagggccugauccccaaguucaaggaguccggcaagaacauccucccccugaaguacauccugaagacggggaccauggugaucuucugggagaacuacccggaggagaucugggacaucgauaagaaccaguuguacaagcggcuguucaaggugacccaguucgagagcgacggccgcauccaggcccgauuccaccagaucgcgaagcccgacaacgaacugaccaaggucuccgagcucgacuucagcaacaucgccgagaagauccgccuguccaaggggaaccuuaacaugcucgugaacggguacgacuucaaaaucaacgugcuggggcacaucgaaaagcugagcuga

SEQ ID NO: 7570 - RNA, 3957 nt, Artificial Sequence
  Cas9 variant
augggcagcaacaugcugaagaaggacuacuccaucgggcucgacauuggcaccaacagcguggggcacgccgucgugacagacgacuacaaggugcccacgaagaagaugaaggucuuuggcgacaccucaaagaagacuauuaagaagaacaugcuggggguccugcuguucaacgagggccagaccgccgcggacacacgucugaagcggggcacacgccggcgcuacacccggcgcaagaaccggcugcgcuaccuccaggagaucuucgcaccggagcuggccaagguggaccccaauuucuuauaccggcucgaggagagcucccuggucgccgaggacaagaaguacgacguguacccgaucuucgggaagcgggaggaggagcuguuauaccacgacaccuacaagacgaucuaccaccuccggagcgcccuggcgaacaacgaccagcccgccgaccuccgccugguguaccuggcccucgcccacaucaucaaguaccggggcaacuuccugcuggaaggggagauugaccucagaaccaccgacaucaacaaggucuucgcggaguucuccgagacccugaaugagaacagcgacgagaaucucggcaagcucgauguggccgacaucuucaagaacaacacauucuccaagacuaagaaguccgaggagcugcugaagcucagcggggccaagaagaaccagcuggcccaccaacuguucaagaugauggugggcaacaugggcagcuucaagaagguccuuggaaccgacgaggagcacaagcuguccuucggcaaggacaccuacgaggaugaccugaacgaccuccuggccgaggcgggggaccaguaccuggacaucuucguggccgccaagaaaguguacgacgccgccauacucgcgagcauccuggacgucaaggacacccagaccaaaacgguguucucccaggccaugaucgagagguacgaggagcaccagaaggaccugaucgagcucaagcgcguauucaagaaguaucugccggaaaagugccacgacuucuucagcgagcccaagaucuccggcuacgccggcuacaucgacgggaaggucagcgaagaagauuucuacaaguacacaaagaaaacgcugaagggcauuccugagaccgaggagauccuccagaagaucgacgccaacaacuaccugcggaagcagcgcaccuucgauaacggggccaucccccaccaggugcaccugaaggaacucguggcaaucgucgagaaccagggcaaguacuacccguuccugcgggagaacaaggacaaguuugaaaagauccugaacuuccgcauccccuacuauguggggccccucgcccggggcaacucaaaguucgccuggcugacccgcgccggcgaggggaagaucacgcccuacaacuucgaugagaugaucgacaaggagaccucagccgaggacuucaucaagcacaugaccaucaacgaccuguaccugccgaccgagcccgugcuccccaagcacagccugcucuacgagcgcuacacgaucuucaacgagcucgcgggcguccgguacgucacugagaacggggaggccaaguacuucgacgcccagaccaagcgcuccaucuuugagcuguucaagcuggaccggaaagucagcgagaagauggugaucaagcaccucaagguggucaugccagccauacgcauccaggcgcugaagggccuggacaacgggaaguucaacgccucguauggcaccuauaaagaccucguugacauggguguggccccggaguuacugaacgacgaggucaacagcgagaagugggaggacaucaucaagacgcucaccaucuucgagggucggaagcugaucaagcgacggcuggagaacuaucgcgacuuccucggcgaggacaucuugaggaagcugucccggaagaaguacaccggguggggccggcucagcgccaagcuauuggaugggauauacgacaagaagacucacaagacgauccucgacugccugaugaccgaggacuacucccagaacuucaugcagcugauuaacgacgacaacuacagcuucaaggagaccaucaagaacgcccaggugaucgagaaagaggaaacccucgcgaagaccgugcaagagcugccugguucccccgccauuaagaagggcauccugcagagccucgagaucgucgaugagaucaucaaggucaugggauacaagcccaaguccaucguggucgagauggcccgagagacgcagaagacccacggcacccggaaacgcgaggaccgggugcagcagaucguggagaacuugaaggacgccaacgagcugccggagaaguuacccucgaacgccgagcuguccgacgagcgcaaguaccuguacugccuccagaacgggcgggacauguacacuggcgcgccuuuagacuacgaccaucuccaguucuacgacgucgaccacaucauuccccagagcuuccuaaaggacgauuccaucgagaacaaggugcugacgaucaagaaggagaacgugcgcaagaccaacggccugccgagcgaggccgucauccagaagaugggguccuucuggaagaagcuccuggacgccggcgccaugaccaacaagaaguacgacaaccugcggcgcaaccuccacgggggccugaacgagaagcugaaagagagguucaucgaacggcagcucguggaaacccgccagaucacgaaguacguggcccagcugcuggaccagagacucaacuaugacgggaacggcgucgagcuggacgagaagaucgcgaucgugacccugaaggcccagcuggccagccaguuccgcuccgaguuuaagcugcggaaggugagagcccugaacaaccuccaccacgcgcacgacgccuaccugaacgccaucgucgccaaccugaucauggccaaauaccccgagcucgagcccgaguucguguacggcaaguaccggaaggcgaaguucaaggggcugggcaaggccaccgccaagaacacccuguacgccaacgugcucuacuuccugaaggagaacgaggucuaccccuucugggacaaagcccgcgaccugccaacgaucaagcgguaccucuaccgcgcccaggucaacaaggugcggaaggccgagcgccagauagggggcuucagcgacgagaugcugguccccaagagcgacucagggaaacuucuccccagaaaggagggccuggacccggucaaguacggcggguacgccaaagccguggagagcuacgccguccugaucaccgcggacgaggugaagaagggcaagaccaagaaggugaagacccucgucaacauccccaucaucgacuccaagaaguaugaggccgaccccacggcguaccuagccagccgcggguacaccaaugugaccaacuccuucauccugccaaaguacagccuccuggaggacccggaggggcggaggcgguaucuggcguccuucaaggaguuccagaaggcgaacgagcucauccugccucagcaccugguggagcuccuguacugggucaacgccaaggacggggagcagaagcuggaggaccacaaggccgaguucaaagaguuauucgacaagaucauggaguucgcagacaaguacgugguggcgcccaagaacagcgagaagauccgccgguuguaugaggagaaccaggacgccaccccgauggaacugggcaagaauuucgucgagcuccugcgcuacacggcagacggcgccgccuccgacuucaaguucuucggcgagaacaucccccggaagcgcuacaacagcgcgggcucccugcucaacgggacucugaucuaccagagcaagaccggccuguacgagacccgcaucgaccuggggaaauuauga

SEQ ID NO: 7571 - RNA, 3960 nt, Artificial Sequence
  Cas9 variant
auguuuagccagcgcaacaaccccuacugcgagcuccuguucaagaucaucgugacaaacaucgaggaaaagaaccuggaggucaucaugggcauccggaacuccgacaucuucuucaucucuaacuucaugugguaccaaaagcugaucaugaugaucaagaacauccucgggcuggaccucgguaccaacuccaucgggugggcccucaucgagguggacgagaacaacauuccgauccgcaucaucgccaugggcagccggaucaucccccuguccacgagcgacaaggaggaguuccagcgcggacuguccauaaccaagaaccagaaccggaccgucagccgcacccagcggaaaggcuacgaccgcaagcagcuccggcgcuccgaccugaagaaaauccugaagaaguacaacaucuuccccagcgaggagcuccugaagcugcccaugcucgaccuguggaagcuacgguccgacagcgcgaauccaaacgaggacaucuccgccgagcaacucggccgcauccuguacaugcugaaccagaaacggggguacaagagcgcccgcagugaggccaacagcgacaagaaggacacggacuacguccaggccgugaagggccguuacgcgcagcucaaggaccgccggcagaccaucgggcaguacuuuuacgaggagcuguccaccgccuucagcgacaagaacaaccaacaguacuucagggugaaggaggaggucuauccccgggaggccuacaucgaggaguucgacaccaucaucaacgcccagaaagacaagcacggcuuccugacggacaaagugauccaccagcuacgcaacgaaauuaucuacuuucagcggaagcugaagucccagaaggggcuggugucgaucugcgagcucgagggcuucgagaagaccgucuacgacaaagagaagaacaagaacaagguggucuucgucggcccuaagguggcucccaagaccagcccgcuguuccagcugugccgcaucugggagguggucaacaccaucucccucaagaucaagaaccccgaggggucaaaguacaaauggggcgagaaggugcccaaccugaagcagaaggagauccuggccgacuaccucuucaagaacgagaaccuguccuucagcacccugcucgagauccuggagcugaagaaggaggacguguacguuaacaagcagauccucaaagggaucaagggcaacgaggccuacgccgcccugcacaacgugcuaggcgaccacgagcuucugaacuucgacguguccaucaucaccagcgaccacaccgcgauacuggucgacaagaagaccggggagauccucgaggagcgcgccggccuggagcuggacgccucacucgagcgggagccccuguaccaguucuggcacacgaucuacucauugaaggaccuggacgaguguaagaacgcccucaucaagcgcuucgggcuggacgaggacaucgccgaaaagcugucccacaucgacuucaacaagcaggcguucggcagcaaguccaacaagagcaugcggaagauccucccguuccugauggagggguacaacuauuccgagagcugcucccuggccggcuauaaucacagcaacucccucaccaaggacgagcgcgagagccagaucacccuggagcggcuugagcucuugcccaagaacaaucugcgccagcccaucguggagaagauacucaaccagaugaucaacguggucaacaccauuuuggagaaguacggcaagcccucggagauccggguggagcuggcccgcgagcucaagcagagcaaggacgaacggaacgacacggaccugcagaacagccgcaacaagaagcugaacgaggaaaucgggaagcggcucgcggagcugggccugccgguuaccaagcgcuacauacagaaguacaaguucaucuuccccucccucagcaagaaccugaaggacgcccacgugaacaaccagugcaucuacugcggggagaccuucaaccugacagaggcgcucaacggcgacgccuacgacguggaucacaucguccccaaggcccugcuguucgacgacucccagacgaacaaggugcucgugcaccggaagugcaacagcaccaagaccaaccagaccgccuacgacuacaucacggccaaaggggaggaggagguccgcaucuauuccgagcggguggacgacugguucaagaagggcaucaucagcuacuccaagaugcagcgccugaaggugagccauaaggaguaccuggagagaaagaagcucggcaaggagaccgagaccgacaagaagcugugggagaacuucaucgaccgccagcugcgcgacacccaguacauaucgcgcaagagccgcgagauccugcagaaggucugcaacaacgugacgaccaccgagggcggggugaccgcgaagcugcggaaccugugggggugggacgacauccucaugaaucuacagaugcccaaguacaaggagcugggccagacgaucaccaaggaguggaccuccgagcaugggaagcgcaagcaccaaaaggaggaaaucgagaacuggaccaagcgggacgaccaucgccaccacgccauugacgccuuagucguggccugcaccaagcagggcuucauccagagaaucaacacgcugaacagcuccgagaccaaggaccugaugaucaaggagguggaggaggcgaaaaucgaguucaacgagaagaccacacuccuagagaaguaccugaagacgcagaagccguucaccacccgcgaggucaugaaggaggccgacaagauucucaucagcuucaaggccggcaaaaagguggccaccaucacgaaguucaaggccaccgggaagaacaaggagaccggcguuaucgucccccgcggggcguugcacgagcaguccguguacggcaagaucaaggugaucgagaaggacaaaccccugaaguaccucuucgagaaccccgacaagaucgucaacucccggaucagagaucugguggagacccgccugucugagaaugagaacaacagcaagaaggcccucagcacggugaagaagaacccgauauucuucaacgaggagaagaacgagauucuggagaaggccuccuguuacaacgacgccaccguacugaaguacaagcuccagaaccugaaggcgaaccagguggacgauaucguggacgagcgggucaaguuccuggugaaggagcgccucacccaguuugguagcaaggagaaagaggcguucaaggacauacugugguucaaccaggagaagcagauccccaucaucaccgugcgccuguucgcccgccccgacgccaacaaccuccagaucaucaagaaggacaagaacgggaaggacaucggcuucguccugacggguaacaaccaccacaucgccaucuacgaggacaaggacuccaagcugguacagcacagcugcgcguucuggcacgcgguggagcggaagaaguacaacaucccugccgucaucaaaaauuccgccgacguguggagucuccugcuggacaaggaauugccggugcuguuccuggacaagcuccccgccgacgagcugaaccugaaguucucgaugcagcagaacgaaauguucauccucggccugagccaggagggguuugacgaggccauaaagaacaacgacaagucccugcucucuaagcaccuguaccuggucugguccaucagcaacaacgacuacuacuuccgccaucacuuagagaccaagaacaccgagcugaagaacauccccaccgccaaagacuccaagcgguacuuccgcuucaagagcgugggcgcccuagugggcaucaaccccaucaagguccggcucaaccaccucggggaaaucacuaagaucggagaguga

SEQ ID NO: 7572 - RNA, 3960 nt, Artificial Sequence
  Cas9 variant
augggauacaacaucgggcucgacaucggcacugguagcguggggugggccgcccuaaccgacgaagggaagcuggcgagggccaagggcaagaaccugaucggcguccgcuuguuugacuccgcgcagagcgccgcccagcggcgguccuaccgcaccacccggcgccggcuuagccgccggaaauggcgccugcggcuucuagagaacaucuucuccgaugagaugggcaugaucgacgagaacuucuucgcgcgccugaaguacagcuacguccaccccaaggacgaggugaacaacgcccacuacuacggcgguuaccucuucccgacccagcaggagacccacgacuuccacgagaaguuccagacaaucuaccaccuccgucugaagcucaugaucgaggacugcaaguucgaccuccgcgagaucuaccuggccaugcaccacaucgugaaguaccggggccacuuccucaauucgcagagcaagaugaccaucggggacuccuacaacccccgcgacuuccaacaggcuauccaaaacuacgcggaagccaaaggcuugaucuggagccugaacgacgcccaagagaugaccgacgugcucgugggccaggcgggguucggcuugagcaaaaaggccaaggcggagcgguuacucagcgcguucuccuucgacaccaaggaggauaagaaggccauccaggccauccuggccgggaucgucggcaauacgacggacuuuaccaaaaucuucaaccgcgagcggagcggugacgagcugaagaaauggaagcucaagcuggauuccgaggcguuugacgagcagucucaggccaucguggacgagcuggacgacgacgagauggagcuguucaacgccauccgccaggccuucgacggguucacccugauggaccugcucggcgaccagaccagcaucagugccgcgauggugaagcgguaccaacagcaccacgacgacuuaaagauggucaaggaaaucgccaaaaagcagggacugucccaccaggacuucuccaagaucuacaccgcuuuccucaaggacgacaccgacaagggcaugaaggcccugcuggacaaagcggauuuggcugacgacgugcuaguggagauccagcaacgcauagagagccacgacuuccugcccaagcagcgcacgaaggccaauuccgugaucccguaccagcuccaccuggccgaacuggagaagaucaucgagaaccaggggaaguacuacccguuccuccuggacacguucaccaacaaggccggugagaccaucaacaagcugguggaacucgugaaguuccgggucccauacuacguggguccuauggugaccgcggccgaugucgagaaggccgggggagacgccacgaaccauugggugaagcgcaacgagggguacgagaagucccccgugacccccuggaacuucgaccagguauucaauagggaccaggccgcgcaagauuucaucgaccgccugaccggaaccgacacguaccugauaggggagcccacgcuccugaagaacucucugaaguaccaacuguuuaccguccucaacgagcugaacaacgugaagaucaacggccacaaaaucgacgagaagacgaagcacguccugauucaggauuuauucaagucaaagaagacggugucugagaaggccaucaaggacuacuaccugagccaggguaugggggagauccagaucgucggccuggccgauaagaccaaguucaacuccaaccucagcuccuacaucgaccugucaaagaccuucgacgccgaguucauggagaaccccgccaaccaggagcuguuggagaacaucauccagauccagaccguguucgaggacgugaagauagcggagcgggaacuacaaaagcuggcccucccggacgagcagguccagcagcuggccaagacccauuacaccggguggggcaacuuguccgacaagcuccuuucuaccccaaucauccaggaggggagccagaaggugagcauccugaacaagcuccaaaccacgucuaagaacuuuaugagcaucaucaccgacaacaaguuuggcguucagcaauggauccaggagcagaacacggccgagaccgcugacaguauucaggaccgcaucgacgagcugacuacggcccccgccaacaagcggggcaucaagcaggccuucaacguccuguucgauauccagaaggccaugggggaggaacccaaccgcguguaccucgaguucgcaaaggaaacccagaacagcgugcggaccaacuccagguacaaccggcugaaagacuuguauaagagcaagacgcucagcgacgacgucaaggcccugaaggaggaacuagagucccagaagucuagcuugcagagcgagcgcaucggcgaccgguuauaccuguacuuccuccagcaggggaaggauauguacacgggccagcccaucaacaucgauaagcuauccaccgacuacgacaucgaccacaucaucccccaggccuacaccaaggacgacagcaucgacaaccgcgugcugguuucccggcccgagaacgcacgcaagagcgacuccgcuaccuacacgaccgagguccagcagagcgcgggcggucucuggaagucccugaagaacgccggcuucaucucgcaaaagaaguaugaccggcugaccaagggcggggauuacuccaaagggcagaagaccggcuucaucgcccgccaacucguagagacgcggcagaucaucaagaacguggccagccucaucgaguccgaguucagccagaccaaggccgucgcgauccgcucugaaaucaccgccgacaugcgccggcugguagccauuaagaaacaccgcgagaucaacagcuuccaccacgccuucgacgcccuccugaucaccgcggccgggcaauacaugcaggcuagauaccccgaccgcgacggggccaacguuuacaaugaguucgacuacuacacgaacaccuaccugaaggagcuccggcagucguccucguccagccagguccgccggcucaagcccuucggcuuugugguggggaccauggcgaagggcaacgagaacugguccgaggacgacacccaguacuuacgucacgucaugaacuucaagaacauccucacgacacggcgcaacgacaaggauaacggggcccugaacaaggagaccaucuacgcuguggacccgaaggccaagcugaucggcaccaacaagaagcggcaggacgugagccucuacggaggguauaucuaccccuacuccgcguacaugacgcugguccgcgcgaaugggaagaaccugcucgugaaggugacaaucagcgccgccgagaagaucaaguccgggcagaucgagcuguccgaguacguccagcagcggcccgaggugaaaaaguucgagaagauccugaucaacaaacucgccaucggccaacuggugaauaacgacggcaauuugauuuaccuaaccuccuacgaguucuaccacaaugccaaacagcuguggcugccuaccgaggaggcggaccucaucucucagcugaacaaagacuccagcgaugaggaccugaucaagggcuucgacauccucacauccccggcaauccuuaagcgcuuccccuucuacgaauuggaccucaagaagcuggucaauauccgugacaaauucaucgccguggagaacaaguucgauauccugauggugauacucaaagcccugcagcuggacgccgcgcagcagaagcccgucaaaaugauagacaagaagagugcggacuggaaggacuaccgccagcggggugggaucaagcucagcgacaccagcgagaucaucuaccaguccacuaccggaaucuucgagaaacgcgugaaaauuagcaaccugcuauga

SEQ ID NO: 7573 - RNA, 3963 nt, Artificial Sequence
  Cas9 variant
augaccgagcagcagcgccccuacaacaucggccuggacaucgggaccagcuccaucggcugggccgugacugaccagaacgacaagcuccugcacauccgggggcauaacggcaucgggguccgccuguucaaggagggcgagagcgccgcggagcggcgcggcuuccggaccacccgccggcgccucucccggcgccgguggcgccugcgguuccuggaccgcaucuucgacgccgagcuggcgaagguggacccgaacuuccuggcccgguugaagcagagcaacaucagcccccucgaccccaacaagcagauguucgggaacauccuguucgaugacgcccaguucgacgaccagaaguuccaccagcaguaccccaccaucuaccaccuccgcagcgcgcuggcccagccggacgcgccccaggccgacgugcggcugaucuaccuggcccuccaccacaugaucaaguuccgcggccacuuccugaacggggccgccgucgagaaguuucacggcgggcagcugcacuuagaggccgaguuccaggagcugaaccagaucuucuccaaccagcagcgggaccacgugcagcugcagacgagcucccuggacgaaguagccaccauccugaaggacaaccagcgcacccccagcgaccggcagcgcgagcuguccgcgcgccucuucguccccguagacaagaccaucgacaaggagaacaagaaguuggccacggagcugcucaaggccgugcugggccugaaggccaaguucgacgucauccuaggcguggaggcaaccgacccgcaggcguucaagcugcaguucagcuccgacgacuucgacgacaaaaucgccgagcuggccagcgagcucaccgacgaggccaacgagaucuuaaccgugcugcagcgucucuacuucucccugaaccuggccgacauccucacgaaccgccagaccaaacagguggcggacagcaucuccaccgccaugaucaaccgguacgacgaccacaagcaccaccugaagaugcugaaggagcucgagacccagguaacgcaggagcagcgcgacgggcugaagaaggccuacgacgaguacaucgacggcgacaagcccaccaucgacaccuucuacaccaacgugaagaagaaccuggacgacagcgagcucgccaaccaaaucaagucccugaucgaccugcaggccuucaugcccaagcagcggagcaaggagaaugggagcaucccccaccagcuccaccagcgugagcuggaccagcugaucgagguccagggcaaguacuaccccuggcugcucgcggccaaggacaaguuggacgcccugaucgccuuccgggugcccuacuacgugggacccaugaucgacccaaacgaguccgacgacccgcagaacacgaaguucgcguggaugguccgcaaggaggccggggagaucacccccuggaacuucgaggagaagguggacaagaccggcagcgccaccaacuucaucaagcggaugacgaccacagacaccuaccuccugggggagcccgugcugcccaagaacucccuccuguaccagcaguucacgguccugaaugagcucaacaagcugaagguggacggcaaggcccugaccguggaccagaagaaguaccucuacgagcacgucugcaagaagcagcgccggguaacccugaagaagcugagcgacugccucauggcccgcggggacuucccgaugggcgcgaucuucaccggcacgaccgaccagaagaacaugaacaacacacugaagaccuaccaggacuuccaggagaucuucggggacgagauugacaaccccgaccggcaggucgacuucgagaagaugaucgaaugguccacgaucuucgaggaccgcgagaucuucaagcugaaacucgccgaacugaacuggcugaccagcgagcagcucgagcgcguguccaagaagcgcuaccaggggugggggcggcugagccagaagcugcucacccacaucgugaacgagaacggcgagcgcaucaucgaccagcuauggaacaccaaccagaacuuuauggagaucauggggcaggacggcgucaagcaggccauccaggagcacaacggcgcgaacguugcccagaccgggaucaacgagacgaucgacgagcuguacaccagcccccagaacaagaaggcgauccggcagauccuccugguggucgacgacaucaagaaggccgugggcuacgcccccgccaacaucaugauggaguucgcccgcgaggaccgggacgaccaccggcugaucgcgucccgcgcccggcagcucgagaagaccuaccaggagaucuccaagaacugguucgacaacgagagcgugacccaggagcugaaggaccagaucaagaacaagacgaaguucaccgaccgccuguaccucuacuucauccagggcgggaucgaccuguacaccgggcacccgcugaacaucgaccagcucuccagcuacgacaucgaccacauccugccccaguccuuccugcucgacaacagccugaacaaccggguccugaccucccagagcgagaaccgcgugcacaaggaggaccggcuccccggcgagacgguggccaacaagaugcgccccaccuggaagaugaugcgagagcagggccugaugacccagcgcaaguacaacaaccugacccucaagccagaccagaucucuaaguucaacaaccgggggcaguucaucaaccgccagcuggucgagacgcgccaagugaucaagcuggccgcggacaucaugaaccagaaguaccaggccgaccagaccaaggugguuaccgugaaggccaacuuaacccaccacaugcgggagaaguucaacuucuacaagagccggaacgugaacgacuaccaccacgccuucgacgcuuaccugacggucuucgugggcaacuggcugcucaaggaguaccccaagcugcagcccuacuucguguacggggacuucgcgaagaccggcaccaacaaccucaagagcuucaacuuucuguaccgcuucgaaagagaucacaagcugaacgacaagggcgccaucgacaccgacaaggaccagcagcugggguacaugaagcgcaucuaccgguucaagaagaugcucgucacgaagcagcuggagaccaacgagggcgcccuguacaagcagaccaucuacaaggccccggcuaacgagaagaacaccaagaagaaccgcagucucaucaacacgaagaagaaccggcccagcgacaucuacgggggcuacucccagagcgugaccgcguacaugucccugguguucuucaagaacaccuucaagcugaucaagaugcccuuggucgccgccaacgccaucaagaacagccugucaagcuaccacgacaccauccugaagauccucggguccaacgaguucaaagugcuaauccccaaggugaagaugaaccagcugaucaaggagggagacagccucuacacggucgugggcguguacaagcacaacgcccagcagcugauccuguccgacaacagcauggggaucaucaccaagccgauccgcgagaucugcgacuccgaccucgacagcgucuucaacgagcugguggacaauaucgacaaguaccugaaccucuacaagaucgaggacaagcugaccaucaaggagaaguucuacgcgcugaagaacaaggaguccaaguucaagugcaucagcgacauccucgugggcacgcacugcaacgccgggcgcuccaaccugaagaucaucggccugagcagcuacugggggauguucuccggcaacaacgacggccucaagaucaacgagaacagccagcugaucuaccagucccccacagggcuguucgagcaccgggucaaggugagcgaccucuga

SEQ ID NO: 7574 - RNA, 3972 nt, Artificial Sequence
  Cas9 variant
augaaagacuucuacaucggccuggacauggggaccgacagcgugggcugggcgguagccgacgaggacuacaaccucugcaaguucaaggggaaggcgauguggggcgugcgccuguucgaugaguccgccaccgccgcagagcggcgaggguucaggacggcccgccggcgagcgcaacgaaagcgccagcggauccuguggcuccagaugcuguucaacgaggagaucagcaaaaaggacaucgccuuuuuccagcgccugaaugaguccaagcucuaccuggaggacaagagcaccaacgugcccuaugccgucuucgccgacgaguccuucaccgacguggacuaccacaaacuuuacccgaccauuuaccaucuccggaaggagcuggugcagucugaugagccccaugacguccgccuggucuaccucgcgcugcaccaccucaucaagaaccggggccauuuucucuucgagaacguuggcagcgacuucgagaaggagagcuccuucgagguccuguucaagaaccugcagaauuacauccucggggaguacgagcuggcccuggagugcaucagcccccuccagaucgccgacauccugaaggacaaguccaagcgcaagacgaccaagagcuccgagaucugcaagcugcucggaaucagcaagaaggggcagccccggcugaacgccaucgugcuguuaaugugcggccaguccgugaagcucgccgaccuguacggggacgagaacuacaacaaggaggaaaaguccagcaucagcuucgagaagggcuacgaggacaacgaagagaccuauagggagcuccugcuggagcgguucgagcucaucgagaagaucaaggcguuauacgacugggccaucuuagcugacaucuuaaagggugagaccuacaucuccuucgccaaggucaagacguacgacgagcaccgccacgaccugcaacaguugaaggccuucgugaaggagcggugccgcagcgacuauaacgagaucuuccgggagaccagcgacaagcucaacaacuacaccgcguacugcggcaaguucaaggagaacggccgcaacggaguuauccugcacuccgccaaccagaccgacuuuugcaaguaccucaagagcaaguucgacaagcucgacaagucuggcuacgaagacauguucgagaaaaucgagaacggcagcuucaugccgaagaucgucgugaaggacaacggggugauccccaugcaggucaacgaguccgaggugcgugcuauccugaagaaugccagcggcuaccucgacuuccucaacaaccaggacaaggacgggaucacgguggccgacaagauccugcagaucuucgaguuucggauccccuauuacgucggcccccugaacgugcacuccgauaacagcuggcucgugcgcaaggacgggaagaucuacccguggaacuucaacaagaucgucgacguggacaaguccgcggaggaguucaucaacaagcugaccgccaaaugcaccuaccugcccgaccgggaugucaucccaaagaacagcauccuguacucccgcuacaugguccucaacgaguugaacaaccugaaacucgacgguaagaagcccgacgugagcuucaagcaggccgucuucaacgaccuguucaugcaucggcgcaaggugacccagaaggcccugcgggaguacaucaaagcccagacgggcaccgaaccggagaucaccgggaucgacggcgacuucaaggcgaacaugcgcccggccaucgagcucgccggguacaaccuguccgaacccgacaaggaggagaucauuaaggccaucaccaucuucggcgacgacaagaagcugcucaagcgucgcaucaaggacaaguacagcgagaugcuguccgaggacgagaucaaaaagaucugcaagcugaaguacaaggacugggggcggcucagccgcgaguuccugacggaaaucuucgacguggacacagcgaccggcgaauguaaggacaacaucaucaacacccuguggaacacgaacgacaaccucauggagcugcugggcgccaaguacaacuucacccaguccaucgagcaggccaucagcaaauccacccacaaggccagcaucgagaagauggucgaggauauguaugugucgcccaaggugaagcggaccgucuuccagucccucaaaaucaugaaggaaauugugaaaaucaaggggcacgccccgaagaagguguucguugagaugacgcgccacgacggcaccaagggggacaacggccggaccaaaagccggaagaagcaacuggaggaacuguacaagaagugcaaggaggacuccaccgagcucugggacgagcuggagaagacggacgacgaugaguuccggcaggacaagcuguuucucuacuacacccagauggggcgcugcauguacagcggcgagcggaucgagcugcgcgaccuguucaacaagaaccucuacgacaucgaccacaucuuuccccgcuccaagguaaaggacgacucuaucgacaaccgggugcuggucaagaagcagaucaacucccacaaggacaacgacuacccccuggauagcaccgugagagaaaagaugcggggacacuggcaguaccuccugaggcacggguucaucuccaagaaaaaguacgaccggcugacccgcgugacaccccucacugacgacgagcuggcggacuucaucgccaggcagcuugucgagaccagccaguccaccaaggccguggcaacccuccugaagacgcuguaccccaccaccgagaucguguacguuaaggccgagcucgugagccgcuuccggaccgaguacaaguuuaucaagugccgcgaagugaacgaccugcaccaugcgaaggacgccuaccugaacaucgucgugggcaacguguacaacguccgguacacgcacuccaaggccaucuucaucaaggggcuccagaccaagaaauacucucugaaccgcauguucgccuucgacacccccggcgccuggaacaucgagaacgagaaaucccugagcaucgugaagaagaccgugaugaagaacaacauccucuauacgcgguacuccuacaugaagaagggugggcuguucaagauccaacccuuaaagaaggggaauggccaagcgccccugaagaaggaccucccgcugagcgacaucggcaaauacggaggcuacgacaagcccaccgccagcuacuucuccuacaucaaguacgaggguaagaaggggaaagagugccgccaacuugucgccaucgacaacuaccugaagaaguacuacgaggagaaccccaucgaguaucugaccaaccggcuaggcuuaaagaaccccgccgugcuaaucccggugaucaaguacaacagcugcaucgagaucgacggguuccgcaugaauaucuccagcaaaagcaacgagggcaagaccaucgucuacaagcccgcggugcaguuagugcugggggccgagaaggaggccuacgucaagaagaucagcaagguguuguccaagcccgaggagcagaagaucaccagcuacgacggcgugucagccgaggagaacaucgagcuguucgacgcccugaccgcgaagaugacgaacaccauuuucaagaucaagcuggaggacaucggcaacaagaucaagagcggccgggacaaguucgucacgcucgacgugaagaagcagugcuacgugaucaacgagauacugaagaucaugcacugcaacgucgugaccggcgaccugucccucaucggggccgccaagaaggccggcaucgugagcaccaacuccgcccugagcgagaucaagaaggucuccagcaucaugcugaucaaccaguccgucaccggccucuucgagaccaagaucgaccugcugaacauuuga

SEQ ID NO: 7575 - RNA, 3975 nt, Artificial Sequence
  Cas9 variant
augagagccaagggcaaaacccugaucgggaccagccucuuccgggagggcaacacggccgcggagcgccggggguacagaaccacccagcggcgccugaagcggcgcaagcggcgccugaagcuccuggaggccuucuucgauccguacaucuucgagguugacgagaacuuccuggcccggcuccacgaggccgacaucuccccaaaggacgagaacaagcgcuucuggggcagccugcuguuccccaacgagaaggacgccaacuucuaccggaaguaccccaccaucuaccaccuccgcaaggcgcugauggaggaggaccggaaguucgacguccgugccaucuuccuggccauacaccacaucaugaaguaccgggggaacuuccucagcccccugagcguggacuccuucaagcaggagggccuggagcucaaggagcagcuggaccgccagcugaagcgcguggccgagcucuacaaugagcugaauacugacgucaagaucaacgugagcgacguggagaccauccaggacauaaucaucgacaagaacaagucccgccgggacaaggcgggcgcccugaagaagcuccuggccgucuccuccgaccgcaaggagaucaacaagcugaacgccagccucgccaaggagcuguccaacgcgaucuuggggaugaaggcccaauucgccaaccuccugcuggccgacgaccucgagaucgacaagaacaagaagaacuucagccugcuggacaccaacgccgaggagaacguguccggccuccuggagcuggugaacgagaagcaggcggagcuguucgacgccaucaagaccauccacgaccagaucauccugaacgagaucgucccggacgguaagagcaucucccagagcaugguggacaaguacgaggcccaccgcgagcagcuccaggugcucaaggcccuguacgagaagauggacgccaagcagaucaaagcgaucaagaaggccuacucccuguacaucgacgggaaggaccccaaggccaagaaggucgacaagcgggcccaccagaaccgcgccgacuucuacaaggaggugaagaagguucucgucgagcuggacgacagccgggcggagaagcugcucgggcugaucgagaugggccaguuccugcccaagcagcgcacggccaugaacggggugauccccaaccagcuccaccagguggagcuggacaagaucaucgagaugcaguccaaguacuacccgugguuggccgagaagaacccggucaagucucaccagaagcgggcucccuacaagcuagacgagcuccugaccuuccgcgugccauacuacguggggccgauggucaccagcaagaagcagcagcagaccuccaacagcaacuuugcguggauggugcggaagcaggagggcgagaucacgcccuggaacuucgaggagaagguggacaccaucgccuccgccaacgacuucaucaaacgcaugaccgccaaggacaccuaccuggucggcgaggacgugcuccccgccaacagccugcuguaccagcgguacaagguccucaacgagcugaacaacaucaaggugaacggcagacggcugcccguggagcucaagcgcgaggcguacgucgcccuguucgaaaauggcgacuccaagacggugagcgccaagugcuucaagaacuggcugaacgugaaguugaagaaccucaauucccugaagcuggaggggcugagcaccggcaccaaguucgacaauaaccuguccaccuaccacgaccucaagaagaucuucgggaaggccgucgacgacgccggccgucagaaggacuucgagcagauaauugaguggcugacgaucuucgaggacaagaagauccugcgcaucaagcucaaggagaucgaguggcugaccgaggagaacaucacccagcugacccggcucaacuacaacggguggggccgccugagccggcgccugcucacgggcaucugcgacuccaacgggcagaggaucauggacuggcugugggacaccaccaacaacuucaugcagauucagagccagccggacuuccagaaagcgaucguggaguacaacuccgacaaacuggagcagggcgacaucgagcagauccucggggaggccuacacgagcccacagaacaaaaaggccauccgcaaggugaucaaggucguccaagacguggagaaggccaugggcgccaagcccacguccaucagcauagaguucacccgguccgacgggcggagcgagcugaccaacucccgcaugacccagcugcagaagacgcucaugagccugagcgaggagaugaccgaccaggcgcugcucgccgaguucaaggacuuccaggcuuccaagaagaagcugaccaacaaguacuaccuguacuucacccagcucggccgggacauguacacgggcgagccccugaacaucgaccagcugagccuauacuccgacggggaccacauccugccgcgcagcuucaucaaggacgacucccuggacaaucggguccucaccaagcgcgccgugaacaacgagaaguccgacaccgugcccgucugcgaguacggcgcgaagaugaaagacuucuggaacgaccuguaugacaacgggcuuaucuccaagcagaagcucgccaaccugcugaccgaucccgacgagaucggccccuacaaggccaacggguucauccggcgccaacucguggagaccagccaggugaucaagcuguccgccgagauccugcagacgcuguaccaggacaccaagaucaucgagguccggcagaaguacacccacgagcugcgcgagcauuucaacuucgugaagauccggcagcugaacgacuaccaccacgccuucgacgcguaccucaccgccuucagcggccgcuaccuguaccagcgguacccgaaacugcgcggcuacuucgucuacggggacuauaacaaguucgacgccaagaaggaccggaacuaccugaaguccuacaacuuccuguacgaccuggaagagggcaagacggaccagaucgucgacaacguggagcacaagguguucaugaaccgccaggacgccaucaaccagcucaagaaggccuacgaguacaaguacaugcuggucagccaggagaccuacaccaacuccggggcgauguucaaggagaccauauaccccgugaaccccaaacagaagcugauccagaagaagaacgacaagcccguggacaucuacggcggcuacagcaacaacuacgacgccuaccucuccaucguccggcuggaggacaagaaggggaucaaguuccgcgucgugggcaucccgaugcggaacaaggccgagcucgacaaccuggccaaggaggaccacaacggguacaugcagcgccugaacgagaucguugacgagcagaucaacagcuccggcaagaagaagacguuccggaucauccugcccaaggugcacuucaagcagcucguggaggacgacagcgguaaguucaugcugggcagcgccgcguacccguacaacgccaagcagcugguccucuccgucaagagcaucgagucccuggccaacaaggacgccagcgaccgcgagcugguggcgguguacgaggagauccucaacguggugaacgacaaguucacccuguaugacgcccgccaguucagaaauaagcugaccuccagcaaggacaaauucguggagcucaacaccgccgacaaggugacggagcugcuggacauccucgacggccugcacgccaacccgguggucaagaagcugaagaucaucuccgggagccccuucggcuuccuccagcgccccuccgggauugugcugaccgagaacgccaagcugaucuaccagagccccaccggcaucuucgagcggguggucuaccuccgggaccuguga

SEQ ID NO: 7576 - RNA, 3984 nt, Artificial Sequence; identical to SEQ ID NO: 1776
  Cas9 variant

SEQ ID NO: 7577 - RNA, 3984 nt, Artificial Sequence
  Cas9 variant
augaagaacuacagcaucggccuggacaucgggaccggcuccgugggaugggucugcaucgacgagaacuaccagauccucagguacaacaaccgggccgccuucggcgugcacgaguucgagaccgcgcacguggccgaggagcgccggaucaaacgcggggcccggcgccgguacaaccgccggaagaagcgcauccagcugcugcagagccucuucgucccccacaugcagcagaaggccuucuucgccccgacgaucaccgagcacuacuggaagaacgauaaccaguucgagaaccggacccuguccgaggugcugaugagccucggcaugaacccaaacaccuaucccacgaucuuccaccuccgccacgagcugaucgaguccagcgugaagaaagacgcgcggcugaucuaccuggcccugcacaaccucgucaaguuccgcggccacuuccugcaggagggguccaccuggaacgccaacauguccgacgccaaccuguccgagcaguucgagcagcuccugcacaucuacaccgagauggaggagcugccucaggugagucucaccgcgcagcaguccacggacguggagcacauccugcugaacaaccacauaagcaaggccgagcgggcccgccagcucaccgcccucuucgagcggaccuacgagccguucuucaaacugaucgucggccucgacaucgccgcggcccagcuguucaaacaguccgagcagcagcugcucuacaaggagagcaagaccaaggugaaccugacggccgagacccugcccgaggugcuccaaaccaugcuggaacccgaggucgcguucaucgaggccgugcagcccuucuaccagcagaccgugcuguucgaccuccuaaaggggcaguccuacgucgcggccgccaagguggaggccuucaaccaguacgagcgcgaccuggcuuuacucaagagcguaaucaacgaggucggcuccgagaagcaguaccgggcguucuucaucacgagcaagcagaagaagcgccaguucgagcagaaaccgaacauggagcugcugugccaccuggaccgguucaaccgcgagaagaaguacgaggagaccuucuacaaggagguguccaagcugcucaccgcccugaucaaggaggccaccggggaggugaaggagcacaucgagcagaucauacaggccauggagagccagagcuuucuuguuaagcagaagggcauccagaacgccuccauccccuaccagaacagccucuacgaggcggagaugauccugcgcaaccagcaggcguacuaccccuggaucacggacgaguucaucgagaaggugaagcagcugaucgccuucaggauccccuacuacaucggcccgcucgugcagggggacgagcagcccuuuggcuggcugcagcgccaggccgacgggaacaucaccccauggaacuucgacgagaaggucaacaaggcggccucggccgagagcuucaucacccggaugaccaagaacugcacguaccugaaggaggagaaggugcugcccaagcagucccucauguacgagaaguucacccugcugaacgagcucaacagcguccagauccgcuccagccuggagcagccgcacaaaaagcaccggcugugcgaggacaugaagcaguggaucaucgagcacguguucaagaagaccaagaccgugacgcacaagacccucauccaggcccugaagaagagucccuacaaggacgagcuguacgacgagagcaccggcaacuggaaggacgucuacggcacccagaaggaggacagguucgccuccagccuauccacguacaucagccugaaggagaucgugggggacaucguggacaacgccuucauggaggagaucaucuacuggcugaccgucuucaccgaccgggacaucaucacccucaagaugaacgauaaguaccccuucaucacggagcagcagauccagcgccugcugucccucaacaucagcggcugggggcagcugucccagcggcugcuccagagcauccccguggacgacaugaaccgcuccgugaucgaguacauggagaagcaugccgucaacuuuauggagcugcugagcccgcggcagagcgaccucgccuacaagaucgagcaggucaacaagcagcacuccaagaagauccacaagauccgcuaugaggacaucgagcagcugaccggcagccccgcccugaagcgggggaucuggcgcuccgugaaaaucaucgaggagcucaccgccaucuucggcgagccuaagaacaucaugaucgagguggcgcgggaggaccaggccagccaccgcaccaagucccgcaaagagcagugggagagcaucggcaagucccuggccaaggaggagaaggagcugaaggccuucuucaaggagauggcccaguaccccaagcagcaguucgaccgcacacgguucuggcucuacgugacgcagcaggggaagugcuuguacaccggcaagacccugcgccucgaggaccugagcuccuacgagaucgaccacauccugccgcgcaacuucgugaaggacgacagcaucgacaaccucgcacuugucuaccccauggccaaccaggagaagaacaaggccgggaacaacaagaugccccuggagaucaucgacgccaagcagcagcccgcgaugauggcccacuggaagcggcucaaucaacugaagcugaucuccgacagcaagcuccacaagcugaugaagccguccuucaacgacguggacaaggagaacuucaucgcccgccagcugguggagacccggcagaucaucaagcacguccgcgaccuccugcaggagcgguucgagcacacggacauccacguggugaaggccaagauggucagccaguuucgcaaguucucccggaucccuaagauccgcgacuacaacaacaagcaccacgccauggacgcgcuguuuaccaccgugcugauccaguucauccugcagaaguacggcaagaacuuccugcaguucgaccuccagcacaaggacaucagcaagaagugguccaagaucgcccagagcaccaagcacuucuuccuguuccagcaguucgccgagcagcagaucaagucacccgugacgaaggagcugguauccggggugcaguacuucgagcacaucuucuacgagcagagcuggcagaccaccaagaugacccagacgaucgacuccaauuucuacaaggagaccaucuucagcccgaagcucaagaccgccaaguacacguccgccaaggcggagaaguucgugcacgacgccaucgucaaguacgccgugugcggcauccaguacacgagccugaagaagaacaaggagcagcaccacgugcugcucaccgacaucaacgucaucgagcacuaccaguuaaaggaggccucccugaacgagcucgcccugcaccuggcgaagcgggagagcaaggacgacgugaucgacgcccagaugcucguggucauccccaaguauaagaagaucaugcugaacggcucccccuacuacugcaucagcuccgacgagcgccacaucgccacccaguucgugcugaggaaggaccuccuggaggccguguuacacgucaacgacgagaccagcguggacgagcuccgcacgcuuuuccgguccaucgucgaggagaugaugacccaguacaaggucuacaacaaggacaccauccgcaacaagaucgacgcguucaucgagaccgagcugaucgacguggagacguuccaagugggguucaccgagaucaaaaagauggucgcagccaaugcccagcggagcgacaaguucggcgggcgccuccgccaggugaugaagguagaggacaucuacaucaucgacgaguccaucaccgggcugcgguaucgcaagccccgcaagcuggucaaguga

SEQ ID NO: 7578 - RNA, 3984 nt, Artificial Sequence
  Cas9 variant
augaagaagaacuacacuaucggccuagacaucgggaccgcgagcgugggcugggccguccucacggaggacuacgagcucaucaagcgcaagaugaagaucuccggcaacacccagaagaaggcggugaagaagaacuucuggggugugcggcuguucgagcagggggagacugccgagggccgccggcucaagcgcaccacgcggcgccggaucgccagacggcgccagcggauccaguaccugcgcacaaucuucgacgaggggaugaaccaggucgacgccaacuucuucgcccgccuggacgagagcuucuccaucaucgacgagaaggagaacgagcgccaccccaucuucgggaacguugcggaggaggccgccuaccacgagcaguucccgaccaucuaccaucuucgggagcaccuggccaacagcuccgagcaggcagaccugcgccucguguaccuggcccuggcccacaucaucaaguucagaggccauuuccucaucgagggugagcugaacaccgagaacagcuccgucuccggcacuuucgaacaguuuaucaagguguacaacgagaccuuuaacguugagaaggcccuggaccucaccgucgaccuggacgggaucgccgagcagaaaaucucgagaaugaaacgggcugagcugauccucucucuguuccccgaggagaaguccaccggugacuucgcccaguucaucaagaugaucguuggcaaccaggggaacgugaagaaaacguucagccugaacgaggacgccaagauccaguucuccaaggaggaguacgaagagaaccucgagacacugcuggccgagaucggagaggacuuccgcagcgucuucgacgccgcgaaguccguguacgacgccaucagccuugccaacauccuuaaggugaccgacgccaccacucgggccaagcugucgagcuccauggucgugagauucaccgaccacaaggaggaccucaagacccugaagcgcuucgugcgggagaaccuacccgacgaguacgacgaccucuucaagaacaagaaggucgcaggguaugccggcuacaucgacggcaacgagacacaggaggccuucuacaaguaccugaagaagacgcuggccaaagccaccggggcggagggcuuccuggccaagauggagcaggaggacuuccugcgcaagcagcggacauucgacaacggggugaucccuuaccaacugcaccucgaggagcugaaggccaucaucaagaaccagaaguccuacuacagcuuccuggacgaggagaagaucagccagcucaugaccuuccgcauccccuacuacgugggcccccuggccaaggagaaggggcaguucgcguggcugacgcggaaggagaugggcaagaucacccccuggaaccucaacgagaaggucgacaucgagaagagugccacugacuucguggagcgcaugacaaacaacgacagcuaccugccaauggagaaggugcugccgaagcacagccuccuguacgagacguucaccguauacaaugagcugaccaaggugcgguacaucgacgacaacggccgcgcacagaacuucuccagcaaggagaagcggcagaucaucaacgagcuguucaagcagcagcgcaaagucaagaaggagaugcuggaagccuucuugaagaacgaguacgggaucgagaaccccaagguggagggcaucgaaaaguccuucaacgccugccuggguacuuaccacgaccucaucaagcugggcauacggcccgagcuguucgagcagccugagcacgagcagcaauucgagcagaucgugaaaauccucacagucuucgaggaccgcaagaugcggcgcaagcagcucgagaaguucucuaacauccugaccgaggaggagcagaagcagcucgagcgaaagcacuacaagggguggggccgccuguccgcgaagcugauccacggcaucguggaccagaagacccagaagaccauccucgacuaccugaucgacgacgacgacuuaccgaagaaccggaaucgcaacuucaugcagcucaucaacgacgagaaccugagcuucaaggaggagaucgagaagaucgccuuugacaacgacaaguccacggaggagaucgugcaggagcuggccgggagucccgccaucaagaagggcauccugcagagucucaagauugucgaggaaaucaucgacaucaugggggagcugcccaccaacaucgugguggagauggcccgagaaaaccagacuaccgcccagggcaaccgcgccagcaaggcccgcaugaaauaccucgaggaguccaucaaaaagcuggggagcuccauacuggaggacgagcccaucagcaaagacgccaaccucuuacggaacgaccgccuauuccucuacuaccugcagaacggccgugacauguacacaggcaacgagcuggacaucaacaaccucuccagcuaugauaucgaccacaucgugccgcagagcuucgugaaggacgacagcaucgacaaccgcgugcugacgaccagcuccaugaaccggggcaagagcaacaccguccccgccgaguccguagugaaaaagaugcgccccaccugggagcgguuacucgcgagcgggcugaucuccaagaagaaguucagcuaccugacgaaggccaccaacgggggccugaccgaagaggacaaggcccacuucauccagcgccagcuggucgagacccgacagaucacgaagaacguggcccagaucuugcaccagaaauacaacaacgagcagcucuccgagaagcccgugcgcguuaucacccucaagagcgcgcuggccucccaguuccggaaggacuucagccucuacaagauccgcgagcugaacgacuaccaccacgcccaggacgccuaccugaacggcgugaucgcucaggcgcuccuuaagguguacccgaagcuggagcccgaguucgucuacggggaguaccagaagguguccauccgggcccuuaacaaggccaccgccaagaaggaguuuuacagcaacauaaugaacuucuucaccuccgacgaaaugguggccaacgaggagacgggcgaggucuuauggaaccgccagcgggacaucaagaccaucaagaaagugaugaauuaccaccagaugaacaucgugaagaaagucgagauccaaaccggggcguucaccaaggagagcauccugcccaagggccccuccaagaaguugaucgcccgcaagaauaacugggccccggugaacuacgggggcguggauagccccacggucgcauacagcgugaucaucacccacgagaagggcaaggccgcgaaggugguccagcaguugguggggauuaagauccuggagcggcaggccuucgagcaagacgagguggccuuccucgaggagaagggcuuuauccaccccaagguccaguugaagcugcccaaguacucccucuaccaguucgccgacgggcgccggcgccugcuggcgucagccgaggagagccagaagggcaaccaaauggugcucccggugcaccugaucgagcugcucuaccacgccaagcacgucagcgacuccucuggaaagucccuggaguaccugaacgagcaccggcacgaguucgccgagcuccuggaggccauccugcaguucaccgaacaguauauagaugcgggcaagaaccagaagaaggugcgcgaccuguacgagaagaaccaggacgccgacaugcgcgagcuggccagcuccuucauccagcugcuacagcuaaauaaacagggcgccccugccgauuucaaguucuucggggagaccaucccccggcgccgcuacaagaacacggcggaaaucguggacgccaccuucaucaaccagagcaucaccggccuauacgaaacccagaagcgccucguuuga

SEQ ID NO: 7579 - RNA, 3984 nt, Artificial Sequence
  Cas9 variant
augaccgaacagcagcagcccuacaacaucggccuggacaucgggaccagcuccaucggcugggccgugacggaccagaacgacaagcuccugcacauccgcgggcacaacggcaucgggguccggcuguucaaggagggcgagagcgccgcggagcgccggggcuuccgcaccacccggcgccggcucucccgccggcgauggcggcugcgcuuccuggaucggaucuucgacgccgagcucgccaagguggacccgaacuuccuggcccgccugaagcagagcaacaucagcccacucgaccccaacaagcaaauguucgggaacauccuguucgacgacccccaguucgacgaccagaaguuccaccagcaguacccuaccaucuaccacuuacggagcgcccucgcgcagcccgacgcgccccaggccgacgugcgccugaucuacuuagcccuccaccacaugaucaaguuccgaggccacuuccugaacggggcggccgucgagaaguuccacggcgggcagcugcaccucgaguccgaguuccaggagcugaaccagaucuucagcaaccagcagcgcgaccacgugcagcugcagacuuccagccucgacgagguggccaccauccugaaggacaaccagcggacccccuccgaccgccagcgggagcugagcgcccgccucuucgucccgguggacaagaccaucgacaaggagaacaagaagcuggccacggagcugcucaaggcggugcugggucugaaggccaaguucgacgucauccucggcguggaggccaccgacccccaggccuucaaacugcaguucuccagcgacgacuucgacgacaagaucgccgagcuggcguccgagcuuaccgacgaggccaacgagauccugaccgugcugcagcgccucuacuucagccugaaccuggccgacauccucacgaaccggcagacuaagcaggucgccgacuccaucagcaccgcgaugaucaaccgcuacgacgaccacaagcaccaccugaagaugcugaaggagcucgaggcccaggugacccaggagcagcgggacggguugaagaaggccuacaacgaguacaucgacggcgacaagcccacgaucgauaccuucuacaccaacgugaagaagaaccuggacgacuccgagcucgccaaccagaucaagagccugaucgaccugcaggccuucaugcccaagcagcgcagcaaggagaacggguccaucccgcaccagcuccaccagcgggagcuggaccagcugaucgagguccagggcaaguacuaccccuggcugcucgccgcgaaagacaagcuggacgcccugaucgccuuccgcgugcccuacuaugugggccccaugaucgacccgaaccagucagacgacccccagaacaccaaguucgccuggaugguccgaaaggaggcgggggagaucacgcccuggaacuucgaggagaagguggacaagaccuccagcgccaccaacuucaucaagcgcaugaccacgaccgacaccuaccuccugggagagcccguguugccgaagaacucccuucuauaccagcaguucaccguccugaacgagcucaacaagcugaaggugaacgggaaggcccugaccguggaccagaagaaguaccucuacgaccacgucugcaagaagcagcggcgcgugacccugaagaagcugagcgacugccucgucgcccggggcgacuucccgaugggggccauuuucaccggcaccacugaccagaagaacaugaacaacacgcugaagaccuaccaggauuuccaggagaucuucggcgacgagaucgacaaccccgaccgccagguggacuucgagaagaugauugagugguccaccaucuucgaggaccgggagaucuucaagcugaaguuagcggagcugaacuggcugacgagcgagcagcucgagcgcguguccaagaagcgauaccagggguggggccgccugagccagaaguuacucacccacaucgucaacgagaacggagagcggaucaucgaccagcuguggaacaccaaccaaaacuucauggagaucaugggccaggacuccgugaagcaggccauccaggagcacaacggggccaacguggcccagaccggcaucaacgagaccaucgacgagcuguacacgagcccccagaacaagaaggccauccgccagauccuccuggucguggacgacaucaagaaggcggugggcuacgccccggccaacaucaugauggaguucgcccgggaggacagggacgaccaccgccugaucgccucccgggcgcgccaacucgaaaagaccuaccaggaaaucagcaagaacugguucgacaacgaguccgucacccaggaguuaaaggaccagaucaagaacaagaccaaguucacggaccggcuguaccucuacuucauccagggcgggauagaccuguacaccgggcacccccugaacauagaccagcucagcuccuacgacaucgaccacauccugccccagagcuuccugcucgacaacucccugaacaaccgcgugcugaccagccaagccgagaaccgggugcacaaggaggaccgccuccccggcgagaccgucgccaauaagaugcggcccacguggaagaugaugcgcgagcaggggcugaugacccagcggaaguacaauaaccugacccucaagcccgaccagaucagcaaauucaacaaccgcggccaguucaucaaccggcagcugguggagaccagacaggugaucaagcuggccgcggacaucaugucccagaaguaccaggccgaccagacgaaggucgugaccgugaaggccaaccucacccaccacaugcgggagaaguucaacuucuacaagagccgcaacgucaacgacuaccaccacgccuucgacgccuaccugacccuguucgugggaaacugguugcugaaggaguaccccaagcuacagccguacuucguguacggggacuucgcgaagacaggcaccaacaaccucaaguccuucaacuuccuguaccgguucgagcgcgaccacaagcugaacgacaagggggccauagacaccgacaaggaccagcagcucggcuacaugaagcggaucuaccgcuucaaaaagaugcuggucaccaagcaacuggagacgaacgagggcgcccucuacgggcagacccuguaucccgcccccaagaacgacaagaagacccggaaccugaucaacagcaagaagaaccgccccuccgauaucuacggcggguacagcaacgagaacggcuccuuccucacccuggugaagcugaagaaggggagcaaguacgacuaccggcucguggccgucccgguguccaagaucagcgagaucaaagaaagcgagcuggcgacgaucgagaaggccaucgcgccccaguuccugaagucauccggcaaguacagagacuuccaggugguccucagcaagauccugaucaaccaaaaggugaucgacgacgguaugauuuucaccaucggguccaagaguuacaagcacaacgcgaagcaggucgugcuguccgacaacagcauccagaucgugucgacccucucccgcaucagcgacaaggagaagcugaucaccguguucgacgagaucgucgauaucacguccaaguaccugcccugguacaaggugaacgacguggagaagaccaagaugcuguuccggcagaugcaggacaucgacgagaugaagaagaucaucgauaacagccugaucggacugcacugcaacgccuccaucaccgaccucgggaaagucggccugagcaaguacugggggcgcuucgugcugaccgccggcaucucccucacgguggaugcccagcucaucuaccagagccccaccggccuguucgagcaccgggucaagguguccgaccucuga

SEQ ID NO: 7580 - RNA, 3990 nt, Artificial Sequence; identical to SEQ ID NO: 1780
  Cas9 variant

SEQ ID NO: 7581 - RNA, 3993 nt, Artificial Sequence
  Cas9 variant
augaagaacgacuacaccaucggccuggacaucgggaccaacagcguaggcuacuccgucgugacggacgacuacaaggugaucagcaagaagaugaacgucuucgggaacaccgagaaaaaguccaucaagaagaacuucuggggcgugcgacucuucgagagcgggcagaccgcccaggaggcccggaugaagcgcaccucccggcgccggaucgcacgccggaaaaaccgcauaugcuaccugcaagagaucuuccagcccgagaugaaccaucuggauaacaacuucuucuaccggcuuaaugagagcuuccugguagccgacgacgcuaaguacgauaagcacccgaucuucggcacccuggacgaggaaauacacuuucacgagcaauuccccaccaucuaucaccuccgcaaguaccuagcagacggcgacgagaaggccgaccugcggcucgucuaccuggcgaucgcccacaucaucaaguuccgcgggaauuuccugaucgagggcgagcucaacacugagaacaacuccgugaucgagcugucgaaggucuucguccagcuguacaaucagacccucuccgaguuagaggguuuccaguucauagacgagagcauagacuucuccgagguguuaacgcagcagcucucgaagucagagcgggccgacaacguacugaagcuguuucccgacgaaaagggcaccgggaucuucgcccaguucaucaagcucaucgucggcaaccagggcaacuucaagaagguauuccagcuggaggaggaccagaagcugcaacucagcacggaugacuacgaggagaacaucgagaaccugcuggccaucaucggugacgaguacggcgacaucuucgucgccgcacagaaccucuaccaggccauccugcuggccgggauccucacguccacggagaagacccgcgcgaagcugagcgccuccaugauccagcgguacgaggagcacgccaaggaccugaagcuccugaagcguuuugucaaggagcacauccccgacaaguacgccgagaucuucaacgaugcuaccaagaauggcuacgcgggcuacaucgacgggaaaaccaaggaggaggaguucuacaaguaccugaagacgaccuuggugcaaaaauccggcuaccaguauuucauugagaagaucgagcaagagaacuuucugcggaagcaacgaaucuacgauaauggggugaucccgcaccagguucacgccgaagaacugcgggccauccuccgcaagcaagagaaauacuacagcuuccuuaaggaaaaccacgagaagaucgagcagaucuucaaggugcggauucccuacuacgugggccccuuagcaaagcacaacgagcagagccgcuucgccuggaacauccguaagagcgacgagcccauccggccguggaauaugaacgacgucguggaugaaaacgcgucagccgucgccuucaucgagcgcaugaccaucaaggacaucuaucucaacgagaacguccugccgcggcacagccugaucuacgagaaguucaccguauucaacgagcucacgaaaguccuguaugccgacgaccgcgggguguuccagagauucagugcagaggagaaggaagacaucuucgagaaacuguucaagucugagcgcaagguaaccaaaaagaagcucgagaauuaccugcggaucgaacuguccaucagcuccccuagcguuaagggcaucgaggagcaguucaacgcgaacuucggcacauaccuggaccucaagaaguucgacgagcugcaccccuaccuggacgacgagaaauaccaggacacccucgaggaggugaucaagguacugacgguguucgaggacagauccaugauccagaaccagcuggaacagcucccgcugaaccugagcaccaagaccaucaaggcccucagccggcgcaaguacaccggguggggccggcugagcgccagacugaucgacgggauccacgacaagaacuccggcaaaacgauacucgacuaccugaucgaggacgagucugacuccuauaucgugaaccggaacuucaugcaguugaucaacgacgaccaccucagcuucaagaaaauaaucgaagacucccagccauacaaggagcagcagucggcggaggagaucguguccgagcugagcgggagccccgcgaucaagaagggcauccugcagucccucaagaucguagacgagcugguggccaucaugggguacaagccuaagaacaucgugguggagauggcccgcgagaaccagaccaccgggcggggcaagcagaacagcaagccgcgccugaaggggaucgagaacggccucaaggaguucuccgacagcguccugaagggguccagcaucgacaacaagcagcugcagaacgaucggcucuaccuauacuaccugcagaacggcaaggacauguacaccggccacgaguuggauaucgaccaccuguccacguacgauauugaccacaucaucccccagagcuuccugaccgacaacuccaucgacaaccgcgugcucaccaccagcaagagcaaccggggcaagucagacaacguccccuccgaggagguggugcgcaagauggaccgcuucuggcggaaacuucugaaugccaagcucaucagcgagcgcaaguacacgaaccugaccaagaaggagcugaccgaauccgacaaggcuggauuccugaagcggcagcuggucgagacgcgccagaucaccaagcacguggcgacgauccuggacagcaaguucaacgaggacuccaauaacagggacguacagauuaucacccucaagagcgcccuggucagcgaguuccguaagaccuuuaauuuguacaaggugcgggaaaucaacgaccuccaccaugcccacgacgccuauuuaaacgccgugguugcgcugucacuccugcgcguguacccccagcugaagccagaguuuguguacggggaguacggcaagaacucgauccacgaucagaacaaggcuaccaucaaaaagcaguucuacuccaauaucacgcgguacuucgccagcaaggacuacaucaucaacgacgacggcgagauccucuggaacaagcaagagaccauugcccaagucaucaagacccuggggaugcaccaggugaacguggucaaaaagguggagauccagaagggcggguucuccaaggagagcauccagccgaagggcgaaucccagaaacucaucagaaggaagcagcaauggaacaccaagaaauauggcggcuucgacagccccguggucgccuacgcgauccuccuguccuucgacaagggcaagcguaaggcccggagcuucaaaaucguuggaauuacaauccaggaccgcgaguccuucgagggaaaccccauccuguaccucagcaagaaggacuaccacaacccgaagguggaagccauccugcccaaguauucccucuucgaguucgagaacgggcggcggcggauggucgccagcgcguccgagacccagaagggcaaucaacuaauuauccccgggcaccucauggagcugcucuaccacagcaagaaaaucaucaacggcaagaacuccgacucaguguccuacauccagaacaacaaggagaaguuccgagagaucuucgaguacaucguggauuucagcagcaaguacaucuccgccgaugccaaccugaacaagaucgagaagaucuucgagaacaauuuccacaaggccagcgagcaggagauugccaaguccuuuaucaaccuccuuacguucaccgcgaugggcgcccccgccgauuucgaguucuucggcgagaagaucccgcggaagcguuauguaagcaucuccgagauuaucgacgccguauucauccaccagagcaucacgggccuguacgagaccagggugcgccugaccgaggucuga

SEQ ID NO: 7582 - RNA, 3993 nt, Artificial Sequence
  Cas9 variant
auggagaaggaguacaccaucggccuggacaucgggaccaacagcgugggcugggccgugcucacggacgacuaccgccugguggcccggaaaauguccauccagggcgacagcaaccgcaaaaagaucaagaagaacuucuggggcgcgcggcuguucgaagaagguaagacagcccaguuccgccggaucaagcgcaccaaccggcgcagaaucgcccgccggcgccagcgggugcucgcccugcaggacaucuucgccgaggagauccacaagaaggaccccaacuucuucgcgcgccuugaggagggcgaccgggucgaagccgauaagcgcuucgcuaaguuccccguguuugccacgcucuccgaggagaaaaacuaccaccggcaguaccccacgaucuaccaccuccgccacgaccuggcgaacagcaaggagcaggccgacauccggcucguuuaccuggcuaucgcccacugucugaaguaccgcggucacuuucucuucgaaggggaguuagauaccgagaacaccagcgucaccgagaauuaccagcaguuccuacaggccuaccagcaguuuuuccccgagcccaucggcgaccucgaugacgcggugccgauccugacggagcggcugagcaaggccaagcgcguggagaagguccucgccuacuaccccuccgagaaauccaccgggaauuucgcacaguuccugaagcugauggucggcaaccaggccaacuucaagaagaccuuugaccucgaggaggagaugaagcugaacuuuacccgcgacuguuacgaggaggaccugaaugagcuguuagagaagacguccgacgacuacgcggagcuguuccucaaagccaaggggguguacgacgccauccugcugagccagauccucuccaagagcgacgacgagaccaaggccaaacuguccgccaacaugaagcugcgguucgaggagcaccagcgcgaccuaaagcagcugaaggaacugguccggcgcgaccuccccaagaaguacgacgacuucuucaaaaaccggagcaagaauggcuacgcggguuacgugaaagggaaggccacccaggaggacuucuacaaguuccugaggaccgaacuggcgggccucgaggagucccagagcauuauggagaaaaucgaccuggagaucuaccugcuuaaacagcggacguucgccaacggggugaucccccaccagauucaccuggucgagaugcgcgagaucauggaccggcagaagcgcuucuacccguuucugaagggcgcccagggcaagaucgagaagcuccugaccuuccggauccccuacuacguggggccccuggcgcaggagggccagucccccuucgccuggaucaagcgcaagagcccgucccagaucacacccuggaacuucgccgagguggucgacaaggagaauagcgccaucgaguucaucgagagaaugaccaaccaggacacguaccuccccaaggagaaggugcugcccaagcagucucugaucuaccagcgcuucaugaucuucaacgagcugaccaagguguccuacaccgacgagcggggcaagagccacuacuucaguagcgagcagaagcgcaagaucuucaacgaacuguucaagcagcacccgcgggucaccgagaagcagcugcgcaaguuccuggagcucaacgaacagaucgacucgacggagauuaaagggaucgagaccagcuucaacgcguccuacagcacauaucaugaccugcugaagcucuccgaccaaauggacacccugcuggacgaccccgacaugacgaccauguucgaggagaucauuaagauccucaccaucuucgaggaccgggagaugauccgcgagcaacugaagccguacgagaccgugcuggggcuccccgcaaucaagaagcuggccaagaagcacuacacgggcuggggccgucugagcgagaagaugauccaggggaugcgggagaagcagucccgcaagaccauccucgacuaccugaucgacgacgacgacuucccuugcaaucggaaccgcaacuucaugcagcugauuaacgacgaccaccucagcuucaaggagaccaucgccaacgaacugauaaugagugacagcaacgugcugcucgaccaagugaaggccauccccggcucccccgcagugaagaaggggaucuggcagagcauuaagaucgucgaggagaucaucggcaucaucgggaaggcccccaaaaacaucgugaucgagauggcucgggagaaccaacgcaccucccggucacgcccgcggcugaaggcccuggaggaggcccucaagaacaucgacagcccccuguuaaaggacuaccccacggacaaccaggcgcuccagaaggaccgccuguaccuguacuaccuacagaacggcaaggacauguacaccggcgagccccuggagauccaccgguugagcgaguacgacaucgaucacaucaucccgcgcagcuucaucguggacaacucccucgacaacaagguccuggugagcuccaaggugaaccgggggaagcuggacaacgcccccgauccccucgucgugaagcgcaugcggagccacugggagaagcugcaccaggccaagcugaucuccgacaagaagcucgcaaaucucaccaagcagaaccugaccgaggccgacaaggcgcgauucauccagcggcagcucguagagacccgccagaucacgaagcacgucgccaaucugcugcaccagcacuucaaccucccagaggaggugagcgccaccgagaagaccuccaucaucacccucaagagcacgcugaccucccaauuccggcagauguucgacaucuacaaggugcgcgagaucaaccaccaucaccacgcccacgacgcuuaccugaacggugucguggcaaugacccugcugaagaaguacccaaagcuggcacccgaguucguguacgggagcuacaucaagggcgacauuaaccagaucaacaaggccaccgccaagaaggaguucuacuccaacauaaugaaguucuucgagucagaggagaucaucugcgacgagcagggggaggucauuuggaacaagaaacgggaccuguccacgaucaagaaaaccaucggcgcgcaccaggugaacaucgugaagaaggucgagaagcagaagggcggguucuacaaggagaccaucaacagcaaggccaaccccgagaagcugaucccgcggaaggccucccucgaccccuugaaguacggcggcuacggcagcccccugguggccuacacugugaucuucaucuucgagaagggcaagcagaagaaggucacaaaggggaucgagggcaucaccgugauggagcagcuccgcuucgagcaggauccucgggaguucuugaagaccaagggguacgagggcguuaagcaauggcugauccucccuaaguacauacuguucgaggcccagggcggauaccgccggaugaucgcgucccaccaggagacccagaaggccaauucuuuaauccuccccgagaaccuggugacgcugcucuaccacgcccgccacuacgacgagaucaaucacaaggucucguuugacuacgugaacgcccacaaggagggcuucaacgacaucuucgacuucaucuccgacuucgggguccgguacauccuggcgccccagcaccuggagaagaucaagguggccuacgagaagaacaaggagguggaccucaaggagaugaucgacgccauccugucucugcucaaauucacccuguucggcgccucggucgaguucaaauucuucgacaucaagauccugaaacgcuacaagagccucaccgacaucugggaagccaccaucauuuaccaguccgugacggggcuguacgagcggcgcguugagguccggaagcugugggacggcgagcgccucuga

SEQ ID NO: 7583 - RNA, 3996 nt, Artificial Sequence; identical to SEQ ID NO: 1783
  Cas9 variant

SEQ ID NO: 7584 - RNA, 3999 nt, Artificial Sequence
  Cas9 variant
augaagaaccgcgagaacaucaaguacuacaucggcguggacaucgggaccaacagcgucggcugggccgugaucgacgagaacggcaaccugcucaagaagggcaagcaccaccugugggggucccggcuguuugaccaggcccagacagcgcagaaccgccggaacuaccgcagcucccggcgccgguacaacaagcgccggcagcgcaucggccuccugcggcugauaaugagcgacauggugcucgaggucgaccccuccuucuucauccgccuagagaagacgaccuuccuggacaaggaggacaagaaggccauccucaaggacaacuacaagaugaacuacaaccuguucugcgacgaggacuacaacgacaaaaaguacuucaaggacuacccgaccauauaccaccuccggaagaagcucugcgagagcgacgagaaggccgacccccgccugaucuaccuggcucuccaccacaucgugaaguaccggggcaacuuccuguacgaggggcaggagcuucaccucgagcccuccaacaaggaggaggaccugaagauccuguucgacauccucggcaagaacaacgacaccguguacgacaucagcgaggagcagauccaguucauccugaagacggucguggagaacaucuccaagaccgccaagguggacgagugcaugagccaguugaagcucaacuccgaggacaagaagaucgucaaggaguucaugcgcgggcuggugggcaacaaguucaacgugagcaagcuguauaugcacgaggaccuccaguucgacgacgaggaccugaagcugcaguucuccgacaagagcuacgaggagaagaucaccgaguacgagaacguacucgaggaaaagauggaguucaucgaccugaugcagcgguucuacuccuggaucgagcugagcaagaucgugggguccgacagccagcacgcguccaucucuggcgccauggugaacaucuacgagagccaccgcgaagaccuccggacccugaaagaggucaugcuaaagaucggcaagaaggaauacgacgagauguucaagccuacguccaagaacguggugaacuacuacaacuacgucaacccgguggccugcagcggggacaagaccgacggcuucuacaaguacgugaagaaggccaucgagaaauccgacgacagccgcaaggacgagauccuccagaagaucgcgaacgagaccuacaugcugaagcagaccuccaagaacaacgccuacauccccuaccagaugcagaaggaugagcugaucaagauccucgaccaccaggagaaguacuaccccguccugaaggagaaccgggacaagaucaucagcauccuggaguuucgcauccccuacuacuacgggccgcucgacggcaacaagcaguucggcuggcugaucaagaagaaggggaaggagaacgagcgcauccugcccuggaaccaccaggagaucguggacgugcaggagacggccgcccaguucauuaagaagcucaccaacuauugcacuuaccugcccaucgagaaggucaugccccagaagucccugaccugcagcauguacgaggugcucuccgaagucaacaagauccggaucgacggcaagcugcucccgaucgacacgaagaacagauugaucgaggaccucuucuucaagcggaagaccgugaaggagaaggacuugaucaacuggcugaagcagaaccagcucaccgugggggagaucaccggcuaccagaaggagaaggccuucagcuccagcuuagcccccuggaucgacuucaaggagaucuucgacgagaucaacgacuccaacuacgaccugaucgagaagaucaucgaggacaugacaaucuucaacgaggggagcauccucaaggagaggcugaagaaggccuacaaccuggaccagaacaaggucaagaagaucaugaagcucaaguacuccggcuggagucggcuguccaagaagcugaucaacggcauccgcgccgacaacaaguucggaagcuccgugagcauccucgacgugaugaaggagagccauauggcccuaauggagaucaucaacgaccaggaccuaggcuucaagcagaucaucgagaaggagaacuucaagaacgagaccggguccuucgaguacgaggacaucgagaaccucgcuggcagcccugcgcugaagcgggggaucuggcagacccugcaggucaucgaggagaucaagaacuacaugggccacgagcccaagaacaucuacaucgaguucgcccgcgaggagcaggagaaggugcggaccacgacccgcgugaagaagcucaaguccaucuacaacgacaucaagaaccagcuggacguccacgggaaggagguguacagcaaccugaacaagcaagacgagaaguccagcaucgagaagcggcucuaccuguacuacacccagcuggggaagugcauguacuccggcgagagccucgacaucgauaagcuguccaacuacgagaucgaccacaucuucccgcgcacccugacgagcgacgacucccucgacaaccuggugcuggucaagaagaaggagaaccagcggaagcucgacgaccuggugcugccccucgagauccgcaacaagauggagguguucuggaagaagcuguacgacaacgggcuuaucacccagaccaaguacuaccggcucaugcgcgacgaguuccggcgcgaccagaucgacaaguucaucaaccggcagcuggucgagacccgccaaaucaucaagcacguggccaacaucaucgagaaccacuacgaggacacgaagguguucaccguccgcgccaaccugagccacgaguuccgggagaaguacggcaucuacaagaaccgcaacgugaacgacuuccaccacgcccacgacgcguacaucgccugcaucaucgggcgguacauccagauccgcuuccccggccucgaggccaaguacguguacggccaguauaugcagaacgucaagaagaccaagaacaacaucgacaaggagaaccacggguucaucaucaacuccaugaaguacgagugcaucgacgaggacaccggcgaggugaucuggaaccccgaacggauucuggacuacaucaagugcuucaacuaccgcgacguguacaucaccaaaaagcuggacaccaacaaccgggagcuguucaaugucacgaucuuaccgaacgacaagaacagcgagaaggggaaaaccaaggccaccauccccgugaacaagcugcgcagcaacgugcggaaguacggcggcuucagcgggcuccaauccgacaucguggccaucgagggcaagaaggggaagaagaucgaccgccggcugaucaaccugcccauccuccugcgcuacgugagcaucgaggaccagugcaaguacauaauggagaacaacaaguacagcgacgugaagaucaucaagaagaucaagaagaaccagcugaucgagaucgacggcaucugcuacuaccucaaguccgcggacgagcuggauacggccuaccagcugauccucagccgggacgacaacgagaugaucuaccgcaucgaccgggccauccagaacaacgacuucucguacuucgacaacaagaaggagaacaucgacgagcuguaccgccuuaucugccacaagaugaucgagaacuaccccaaauacaagaagaaggucuaugaguucaucaaggagcgggaagaggaguuuuucgagcucgacaacagccagaagugcaucgugaucuucgagaugauccgcgugaugaagcgcggggagcaguacaucaacaucccguucgagcccuacaaccugaagaacgaccggaagggccggcugaacugccaguccauccuccuggauaacacauacuucuacgacgucagcaucaccggcaucuacuccaagaaguacaaacuuuga

SEQ ID NO: 7585 - RNA, 3999 nt, Artificial Sequence
  Cas9 variant
augcagaagaacuacaccaucggccuggacaucgggaccaacagcgugggcugggccgucaugaaggaugacuacacgcucauccgcaagcggaugaaggugcuagggaauacggacaucaagaagaucaagaagaacuucuggggcgugcgccuguucgacgagggggagaccgccaaggagacacggcucaagcgcggcacgcggcgccgguaccagcgccggcgcaaccggcuaaucuaccugcaggacaucuuccagcagcccaugcucgcgaucgacgagaacuucuuccaccgccuggacgacaguuucuucgucccggacgacaagucuuacgaccggcaccccaucuucggcucccuggaagaggagguggccuaccacaauaccuaccccacaaucuaccaccuccgcaagcaccuggcagauaaccccgagaaggccgaccugcggcucguguauaccgcccuggcgcacaucgucaaauaccgcgggcacuuccugaucgagggcgagcucaacacggagaacaccagcaucuccgagaccuucgagcaguuccuggacaccuacucagacaucuucaaggagcagcuggucggggacaucuccaaaguggaggagauccucagcuccaagcagagccggucccgcaaacacgagcagaucauggcccuguucccgaacgagaacaagcugggcaacuucgggcguuucaugaugcucaucgucggcaacacgagcaauuucaagcccguguucgaccuggacgacgaguacaaacugaagcucuccgacgagaccuacgaggaggaccuggacacccugcucggcaugaccgaugacguguuccuggacgucuucauggccgccaagaacguguacgacgcggucgagaugagcgccaucaucuccacggacaccgggaacagcaaggccguccuguccaaucagaugaucaacuucuacgacgagcacaagguggaucucgcccagcugaagcaguucuucaagacccaccuccccgacaaguacuacgagugcuucagcgaccccuccaagaacggcuacgccggguacaucgacggcaagaccaaccaggaggacuucuacaaguacaucgagaaggugaugaagacgaucaagagcgacaagaaggacuacuuccucgauaagaucgaccgcgaagucuuccugcggaagcagcgcagcuucuacaacuccgugaucccgcaccagauccaccuccaggagaugcaggcgauccuggaccgccagagccaguacuaccccuuccuggccgagaaccgggacaagaucgaaucccuggugacguuccgcauccccuacuacgucggcccccucaccgugagcgaccagucggaguucgccuggauggagcggcagagcgacgagccgauucggcccuggaacuucgacgagauugugaacaaggagcgguccgccgagaaguucauugagcgcaugaccaacauggacacguaccugcuggaggagaagguccuccccaaacggucacugcuguaccagaccuucgagguguacaacgagcucaccaagguccgcuacaccaacgagcaggggaagacggagaagcugaaccggcagcagaaggccgagaucauugagacccucuucaagcagaagaaccgcgugcgggagaaggacaucgcgaacuaccucgagcaguacggcuacgucgacggcaccgacaucaagggcgucgaggacaaguucaacgccucccugagcaccuacaacgaccuggccaagaucgacggagccaaagccuaccuggacgaccccgaguacgcggacgugugggaggauaucaucaagauccucacgaucuucgaggacaaagccaugcgcaagaagcagcugcagaccuacuccgacacccugagcccggagaucuuaaagaagcuggagcggaagcacuacaccggcuggggccgcuucuccaagaaguuaaucaacgggcuccgggacgagggcagcaacaagacgauccuggacuacuuaaaguccgacgaggggagcuccggccccaccaaccgcaacuucaugcagcucauccgagacaacacccugagcuucaagaagaagaucgaggacgcccagaccaucgaggacaccacgcacaucuacgacaccguggccgagcugcccgggagccccgccaucaagaagggcauccgccaggcgcucaagaucgucgaggagaucaucgacaucaucggcuacgagccggagaacaucguuguggagauggcccgggagagccagaccaccaagaaggggaaagaccuguccaaggagcgccucgagaagcucacggaggccaucaaggaguucgacggccccuccgacgucaaggugaaggacuugaagaacgagaaucugcgcaacgaccggcucuaccuguauuaccugcagaacgggcgcgauauguacaccaacgagccccucgacaucaacaaccugagcaaguacgacaucgaccacaucaucccccaguccuucaccaccgacaacagcaucgacaacaaggugcuggucucccggacgaagaaccagggcaacaagagcgacgacgugccguccaucaacaucgugcacaagaugaagccuuucuggcgccagcuccacaaggccgggcugaucagcgaccggaaguucaagaaccugaccaaggcggagcacggcggccucaccgaggccgaccgcgcccacuuccucaaccggcagcuggucgagacccgccagaucacgaaacacguggccaaccuccuggacucccaguacaacaccgccgaggagcagcggauuaacaucgugcugcucaagagcuccaugaccagccgcuucaggaaggaguucaagcuguacaagguccgcgagaucaacgacuaccaccacgggcacgacgcguaccugaacgccgugguggccaccacgaucaugaaggucuacccgaaccucaagccccaguucguguacggccaguacaagaagacuuccauguucaaggaggagaaggccaccgcccggaagcacuucuacagcaacaucaccaaguucuuuaagaaggagaagguggucaacgaggaaacgggggagauccugugggacaccgagcgccaccuguccaccaucaaacgggugcucagcuggaagcagaugaacaucguaaagaaggucgagaagcaaaagggccagcuuuggaaggagaccaucuacccgaagggcgacuccagcaagcugauccccgugaaagaggggauggacccccagaaguacggcgggcucagccagguguccgaggcguucgccgucgugaucacgcaugagaagggcaagaagaagcagcucaagagcgaccugaucuccaucccgaucguggaccagaaggccuacgagcaacaccccaccgccuaccuggaggaggccggguacaacaaccccaccguccuccacgagcuguucaaguaccagcuguucgagcuggaggacggcagccgccggaugaucgcguccgccaaggaguuccagaagggcaaccaaauggugcugccccucgaacugguggagcugcucuaccacgccaaccgcuacgacaaggucaaguucccggacagcaucgaguacgugcacgacaaccuggccaaauucgacgaccugcucgaguacgugaucgauuucuccaacaaguacaucaacgccgacaagaacguccagaagauccagaagaucuacaaggagcacgggaccgaggacguggagcugacgguggagagcuucgucaaccugaugaccuucaccgccaugggcgcccccgccaccuucaaguucuacggggaguccaucacgcggagccgcuacaccuccauuaccgaguuucggggcagcacccucaucuuccagucaaucacggggcuguacgaaacccgcuacaagcuggaggacaacuga

SEQ ID NO: 7586 - RNA, 3999 nt, Artificial Sequence
  Cas9 variant
augaugaaggaauacagcauaggccuggacaucggaagcagcuccgugggcuucgucgccguggacgaccaguaccgcguaguccgggccaaggggaaaaacgucaucggcacccgcuuguucgaugaggggaagaccgcagcagaccggcgcgggcugaggacgacccgccggcgccuuagccggcgcaaguggcggcucaggcugcugcgggggaucuuugagccccacaucaacgagaucgacgaguccuucuucaugcgccugaaggagagcaauauuuccccgaaggauagcaacaagcacuuccccggagacauccuguuuaacgaccgguccgaccgcgaguucuacgaaaauuaccccaccaucuaccaccuccggcaggcccucaagaccgagaagcgccaguucgacauccgggagauauaccuggcaaugcaccacaucgugaaguaccgcggccacuuccuagagggcgggacugucaccgacuucgaggugggggagcucgaccuggccgggaaauucagccggcugaacgagcuguucgagucaaucaaccuggaggugcccuuuguccuacgccucgacaaucuggaggacgugaaagcggugcugaucgacagccagcgcuccgcccaggaccgccagagaaccuugacuccggacaucuacguccccagcacggacaagaucaccgagaaaagauucaagggcaucgccacagagcuucuaaaggccauuguagggaacaaggcaaaguuugacguguuggcuggccuggagcuggacaaggaggaggccaagcucugggcccugaccuucgacuccgagacguucgacgaggauaucgagcagcuggagggagacaugaccgaggccacccaggaccuaaucgagauccucaagagcuugcggucccucaucagacuggcggucaacaugcccgagggcgugagccuguccgagaugaugauccagcgcuaugaggaccacgccgaucaccucaaacugcugcgggacaucauccauaacaccgacgccgagaaggccgcgggccuccaggcggccuacgacggcuauaucgacggcgugaaggggaagaagacgcccgucgacgacuucuacaaggcaaucaagaagaaccuggaugacagcgaggccgcccaccagauacuggcgcucaucgacaagaacgaguucaugcccaagcagcgcagcaaguccaacggcuggaucccccaccagauccagcagaaggaacuagaccggaucaucgagaaccagaagcaguacuaccccuggcuggccgacgugaacccgaacgagagccgccggaaaguagcccccuacaagaucgacgagcucguaaccuuccgcguucccuauuauguggggccucuggucaccuccgaggagcagaagaaguacgguagcaaauucgcguggaugguacggaaggaggagaagggugaaaucacccccuggaacuuugaucagaaggucgaccgcgcagcguccgccacggaguucaucaaucggaugaccaccauggacaccuaccugcucaacgaagacgugcugccggcccacagccugaucuaccagaaguaugaggugcugaacgagcucaacaaggucaagaucaacggggaugccaucacgcccgagcugaagcaaaagaucuaccacgaccucuucgagaagcagaccacgguauccaucaagaaccuccagaccuaccuggugagcgaguccgaggcgagcgagguccccgagaucaaggggcuggccgacgagaagaaguuccuuuccggacugacuaccuaccacgaccugaugaagaucuucgaccgcaacguggucaaugaccccgagcgggccgaggacuucgagaaaaucauccgcuggagcaccguguucgaagacaagcacauauacagggagaaacucgacucccugagcuggcugaccacggaccagaaggaucgacucgccgugaagcgcuaccggggguggggccgccuguccgagaaacugcucaucggccugcgggacgagggccaccgcagcaucauggauuaccugugggagaccaccuccaacuucaugcagauccaggcccagaacgacuucagugagaagaucgcggccgagaacaaagaguuccuggacaauacacaguccgugcaggggaucaucaacgagcuguacacgagcccacagaacaaaaaggccauccggcaaacucugcucguuguggaggacaucaagaaggccuuucacggcgaggcucccaagcgcauauuuguggaguucgcucgggagaacgagagcacgccccagagguccauacagcggcagcgacaggucgagaacgccuaugaaaaggugacccagaaccugcugguggacgacaagaucagggccgagcucaaggacagcauaaacgaaaagcgccuguuccaugaccggcuguuucucuauuucaugcagggcgggaucgacauguacucggggaagaagauuaacaucgacaaccugagugccuacgacaucgaccacaucuuaccccaguccuucaccgucgauaacagccucgacaacagagugcugaccaaccagaaagacaaccgggagaagggcaauucgcugccgagcgaacucuaucgcggcuccaugaaggagaccugggagaugaugcggaaccaggggcuguugucaaagggcaaguuccaccgccucaugaugacccccaacuccaugaccgccuacgaccagcagggauucaucaacagacagcugguggagacccgucaggucaucaaacucgcgguggagauccucgcgagcgaguuugaccaggcagacgagaagguggagauugucuccgugaaagccggccugacccaccagaugagacaggacuucagccuuaucaaaaaccgcgacguuaacgacuaccaccacgcguuugacgccuaccucaccgccuuuguaggcacauaucugcuuaagcgcuaccccaagcuccgucccuacuucguguacggggaguucaagaaguucucccagaagcaggccaaccugacgaacuucaacuuccugugggcucucaaacacaaggaccagguggcggucgaggacacaggugagaagaucuggaacaagccgcaggaccuggccuacauccgccaccuguuugccuucaagaagauacucaucagccgggagguguccgagagacacggggccuuauucgaccagacccuguacaaggccagcgacgauaaggcgagcggccagggguccaagaagcucauccccgcgaaggacaaccggcccaccgagcuguacgguggcuacagcggccagacguccgcguucauggccaucgugaaggugaccaaaggcaagaaaacuaaguaccugguggucggggucccgaccgccgcaaucagccagcuccagggcauggacgugaaguccagccaauacacggagaagaucuacaacauccuuucucccaagcugcucagcaagaacgaugacuucgaggugaucguccccaaggugcgcuaccggcaacucauccuggauaacaaccagcuuuucacccuggggucagacaccuacaaguauaacgcccgccagcuggugcucagcaacgagguuuuggcugugaucaaccgggauaaguccuucauugacaagaaacugucugaggaggccgagaaucaggcucucaacgacgcauucgacgagaucgugguugccauggacaagcacuucgaccuguacgacaagaauggcuuccgcgagaagguaaaggcuggcaagcagcgguucgaagaacugcccgugucccucuuuagcgaggacaaggagaacgaagggaucaccaagaggacgguccugaagaggauccugcagggccuccacgccaacgccaccaccagcgaccugaaggugcuggaugggaaguucuacaacuga

SEQ ID NO: 7587 - RNA, 4002 nt, Artificial Sequence
  Cas9 variant
augaagaacuacaccaucggccuggauaucgggguggccagcgucggcugggugugcaucgacgaaaacuacaagauccucaacuacaacaaccgccacgccuucggggugcacgaguucgaguccgcggagagcgccgccggccggcgccugaagcgggggaugcggcggcgcuacaaccggcgcaagaagcggcugcagcuccugcagucccuguucgacagcuacaucaccgacuccggcuucuucagcaagacggacucccagcacuucuggaagaacaacaacgaguucgagaaccgcagccucaccgagguccuguccagccugcggaucuccagccgcaaguaccccaccaucuaccaccuucggucugaccugaucgagagcaacaagaagauggaccugcgccucguguaccuggcccugcacaaccucgugaaguaccggggccacuuccugcaggaggggaacugguccgaggccgcgagcgccgagggcauggacgaccagcugcucgagcuggucacccgcuacgccgagcuggagaaccucuccccgcuggaccugagcgagucccaauggaaggccgcggagacgcuccugcugaaccggaaccucaccaagaccgaccaaagcaaggagcugaccgccauguucgggaaggaguacgagcccuucugcaagcugguggccggccucggggugagccugcaccagcuguuccccuccagcgagcaggcccucgcuuacaaggagacgaagaccaagguccagcuguccaacgagaacguggaggagguaauggagcugcuccuggaggaggagagcgcgcuacucgaggccguccagcccuucuaccagcaggucguguuauacgagcugcucaagggcgagaccuacguggccaaggccaaaguguccgccuucaagcaguaccagaaggacauggcgagccugaagaaccugcucgacaagaccuucggcgagaagguguaccgcuccuacuucaucagcgacaagaacucccaacgggaguaccagaagucccauaaggucgaggugcugugcaagcuggaccaguuuaacaaggaggccaaguucgccgagacguucuacaaggaccucaagaagcugcuggaggacaagagcaagaccagcaucgggaccaccgagaaggacgagaugcugcgcaucaucaaggccaucgacuccaaccaauuccuccagaagcagaagggcauccaaaacgccgcuaucccgcaccagaacagccuguacgaggccgagaagauucugcggaaucagcaggcccacuaccccuucaucacgaccgaguggaucgagaaggugaagcaaauucucgccuuccgcauccccuacuacaucgggccccuggucaaggacaccacgcaguccccguucagcuggguggagcgcaagggcgacgcccccaucacgcccuggaacuucgacgagcagaucgacaaggcggccuccgccgaggccuucaucagccggaugcgcaagaccugcaccuaccugaagggucaggaggugcuccccaaguccagccugaccuacgagcgcuucgagguccugaacgagcucaacgguauccagcugcgcacgaccggcgcggagagcgacuuccggcaccgccuguccuacgagaugaagugcuggaucaucgacaacguguucaagcaguacaagaccgucucgaccaagcggcuccugcaggagcugaagaagucccccuacgccgacgagcuauacgacgagcacacgggggagauaaaggagguguucggaacccagaaggagaaugccuucgccaccagccuguccggguacaucagcaugaaaagcauccugggcgccguggucgacgauaaccccgcgaugaccgaggagcucaucuacuggaucgccguguucgaggaccgcgagauccugcaccugaagauccaggagaaguaccccagcaucacggacgugcagcggcagaagcucgcccuugucaagcugcccggcugggggcgcuucagucggcuccuuaucgacggccugccgcucgacgagcaggggcagagcguccuggaccacauggagcaguacuccagcguguucauggagguccugaagaacaagggcuucgggcucgagaagaagauccagaagaugaaucagcaccagguggacggcaccaagaagauccgcuacgaagacaucgaggagcuggccggcagccccgcccuaaagcgggggauuuggcgcagcgugaagaucgucgaggagcucguguccaucuucggcgagcccgcgaacaucgugcuggaggucgcccgggaggacggcgagaagaagcgcaccaagagccggaaggaccagugggaggagcugaccaagacgacccucaagaacgaccccgaccugaaauccuucaucggugagaucaagagccagggggaccagcgcuucaacgagcagcgguucuggcuguacgugacccagcagggcaagugccucuacaccggcaaggcccuggacauccagaaccugagcauguacgagguggaccacauccuuccgcagaacuucgucaaggaugacucccuggacaaccuggcccucgugaugcccgaggcaaaccagcgcaagaaccagguggggcagaacaagaugccccuggagaucaucgaggcgaaccagcaguacgccaugcgcacccuuugggagcggcuccacgagcugaagcugaucagcuccggaaagcucgggcgccucaagaagcccagcuucgaugaggucgacaaggacaaguucaucgcccggcaacugguggagacgcgccagaucaucaagcacgugcgggaccuccuggacgaacgcuucuccaagagcgacauccaccuggucaaggccggcaucguguccaaauuccggcgcuuuagcgagauuccgaagauccgggacuacaacaacaagcaccacgcgauggacgcccucuucgccgcggcacugauccaguccauccugggcaaguacgggaagaacuuccucgcguucgaccugagcaagaaggaccgccagaagcaguggagguccgugaagggcagcaacaaagaguucuuccuguucaagaacuucgggaaccuccgccugcagucccccgucaccggcgaggagguuagcgggguggaguacaugaagcacgucuacuucgaacugcccuggcagaccaccaagaugacgcagacuggcgacggcauguuuuacaaggaguccaucuucagucccaaggugaagcaggccaaguacguguccccgaagaccgagaaguucguccacgacgaggugaagaaucacagcaucugccucguggaguucaccuucaugaagaaggagaaggagguccaggagacgaaguucaucgaccugaaggugaucgagcaccaccaguuccugaaggagcccgagucccagcuugccaaguucuuagccgagaaggagaccaacagccccauuauccacgcccggaucauccgcaccaucccgaaguaccaaaagaucuggaucgagcacuuccccuacuacuucaucagcacccgggagcugcacaacgcgcgccaguucgagaucagcuacgagcucauggagaaggugaagcagcugagcgagcgguccagcgucgaggagcugaagaucguguucgggcuccugaucgaccagaugaacgacaacuacccaaucuacacgaaguccagcauccaggaccgcgugcagaaguucgucgacacccagcuguacgacuucaaguccuuugagaucggcuucgaggagcucaagaaggccguggccgccaacgcccagcggagcgacaccuucgggucccgcaucagcaagaagcccaagccugaggaggucgcgaucggcuacgagucuaucaccgggcugaaguaccggaagccccgcucggucgugggcacgaagcgcuga

SEQ ID NO: 7588 - RNA, 4002 nt, Artificial Sequence
  Cas9 variant
augagccagaacaucguggacuacugcaucggccuggaucucgggaccggcuccgucgggugggccgugguggacaugaaccaccgccugaugaagcggaacggcaagcaccugugggggagccgccucuucuccaacgccgagaccgcggccaaccggcgcgccagccgauccauccgccggcgcuacaacaagcggcgcgagcggauccggcugcugcgggccaucuugcaggacaugguacuggagaaugaccccacguucuucauccgccuggagcacaccaguuuucucgaugaggaggacaaggccaacuaccugggcgcggacuacaaggacaacuacaaccuguucaucgacgaggacuucaacgacuacaccuacuaccacaaguacccgaccaucuaccaccuccggaaggcccugugcgaguccacggagaaggcugacccccgccugaucuaccucgcccugcaccacaucgugaaguaccggggcaacuuccuguaugaagggcagaaguucaacauggacgcgagcaacaucgaggaccgccucucggacguuuucacccaguucgccgacuucaacaacauccccuacgaggacgacgagaagaaaaaccuagagauccuggagauccugaaaaagcccuuaagcaagaaggccaaggucgacgaggugauggcccugaucgccccggagaaggacuucaaguccgcguacaaagagcucgugaccggcauagccgggaacaagaugaaugucaccaagaugauccugugcgaacccaucaagcagggcgacagcgagaucaaacugaaguucagugacagcaacuacgacgaccaguucuccgagguagagaacgaccucggugaguacguggaguucaucgacagccugcacaacaucuacuccugggucgagcugcagacgaucaugggcgccacccacaccuacaacgccagcaucuccgaggccauggugagccgguacaacaagcaccacgaggaucuccagcuguuaaagaagugcaucaaggacaacgugcccaagaaguacuucgacauguuccgcaacgacagcgagaagcucaagggcuacuacaacuacaucaaccaccccuccaaggcgccggucgaugaguucuacaaguacguuaagaagugcaucgagaagguggacacccccgaagccaagcagauacugcacgacaucgagcuggagaacuuccuccugaagcagaacagccggacgaacggguccguccccuaccagaugcagcuggacgagaugaucaagaucaucgacaaccaggccaaguacuaccccgugcucaaggagaagcgcgagcagcugcugagcauccucaccuucaagaucccguacuacuucggcccccugaacgagaccuccgagcacgccuggaucaagcgccuggaggggaaggagaaccagcggauccuccccuggaacuaccaggacaucguggacgucgaugccaccgcggaaggcuucaucaagcgcaugcggagcuacugcacguacuuccccgacgaggaggugcugccgaagaacucccugaucgugagcaaguacgaggucuacaacgaguugaacaagauccgcguggacgacaagcuguuggaggucgacaucaagaacgacaucuacaacgagcuauucaugaacaacaagaccgugacggagaagaagcucaagaacuggcuggugaacaaccagugcugcaacaagaacgccgagauaaagggcuuccagaaggagaaccaguucuccaccagccugacgcccuggaucgacuucaccaacaucuucggggaaaucaaccaguccaacuucgacuuaaucgaggacaucaucuacgaccugaccgucuucgaggacaagaagaucaugaagcggagacugaagaagaaguacgcccuacccgacgacaagaucaagcagauccugaagcugaaguacaaggacuggagccggcucuccaagaagcugcuggacggcaucguggccgacaacaaguucgggagcuccgugaccguccucgacgugcuggagaugucacgccugaaccucauggagaucaucaacgaccgggaccugggcuacgcccagaugaucgaggcggccgccuccugccccgaggacgggaaguucacauacaaggaggugcagcgccuggccggcagcccggcgcucaagcgcggcaucuggcagucccugcagaucgucgaggagaucaccaaggugaugaagugccgccccaaguacaucuacaucgaguucgagcggagcgaggagaccaaggaacgcaccgagaguaagaucaagaagcuggagaacguuuacaaggaccucgacgagcagacgaaggucgaguacaagaccgugcuggaggagcugaagggguucgacaacacaaagaagaucuccagcgacucccucuuccuguacuucacccagcugggcaagugcauguacucagggaaaaagcucgacaucgacucccuggacaaguaccagaucgaccacaucgugccccagagccuggucaaggacgacuccuucgacaaccgggugcucgugguccccagcgagaaccagcgcaagcuggacgaccugguggugccguccgacauccgggucaagaugaacagcuucuggaagcuccuguucgaccacgagcugaucucccccaagaaguucuacucgcucaucaagacggaguacaccgagcgcgacgaggagcgguucaucaaccgacagcugguggagacccgccaaaucaccaagaacgugacgcagaucauugaagaccacuacuccaccaccaaggucgccgccauccgggccaaccugagccacgaguuccgcgugaagaaccacaucuacaagaaccgggacaucaacgacuaccaccacgcccacgacgcguauaucguggcccucaucggcggguuuaugcgcgaccgguaccccaacaugcacgacuccaaggccgucuacagcgaguacaugaagauguuccgcaagaacaagaacgacaagaagcgguggaaggacggcuucgugaucaacuccaugaacuaccccuacgagguggacggcgagcugaucuggaacccggacaucaucaacgagauccgcaagugcuucuacuacaaggacuguuacugcaccaccaagcuggaccagaaguccgggcagauguucaaccucacgguccugcccaacgacgcccacucccccaagggcacaacugaggccgugaucccggugaacaagaaccggaaggacgucaacaaguacgggggcuucagcgggcugcaguacgugaucguggcgaucgagggcaagaagaagcgcgguaagaagaccaagcucgucaaaaagauaagcggggugccccugcaccugaaggccgccucccucgacgaaaagaucaaguacaucgaggagaaggagaaccugacggacgugaagaucaucaaggacagcauacccgucaaccagaugaucgagauggacggcggcgaguaccugcucaccucccccaucgaguucgugaacgggcggcagcuggugcugaacgagaagcagugcgcccucaucgccgacaucuacaacgcgaucuacaagcaagacugcgacaaccuggacgacguccugaugauccagcucuacaucgagcuaaucaacaaaaugaaggcccuguacccggccuaccagagcaucgccgagaaguucgaguccaugaccgaggacuacguggcggugagcaaggaggagaaggccgacaucaucaagcagaugcucaucaucaugcaccgcggcccccggaacgggaagauccaguacgccgacuucaacgucggcgaccgcaucggucggaagaacaagaugucccuggaccuggagcgcgugaccuucgugagccagucccccacgggcaucuacaccaagaaguacaagcucuga

SEQ ID NO: 7589 - RNA, 4002 nt, Artificial Sequence; identical to SEQ ID NO: 1789
  Cas9 variant

SEQ ID NO: 7590 - RNA, 4002 nt, Artificial Sequence
  Cas9 variant
augagccagaacaucguggacuacugcaucggccuggacuuagggaccggcucaguggggugggccgugguggauaugaaccaccgccugaugaaacggaacggcaagcaccuguggggaagccgccucuucuccaacgccgaaaccgcggccacgcggcgcagcucccgcagcauccgacggcgcuacaacaagcggcgagagcggauccgccuguugcgggccauccuccaggacaugguccuggagaaggaccccaccuucuucauucgcuuagagcacaccuccuuccuugacgaggaggacaaggccaaguaccugggcaccgacuacaaggacaacuacaaccuguucaucgacgaggacuucaacgacuacacguacuaucacaaguacccgaccaucuaccaccuccggaaggcccugugcgagagcaccgagaaggcggacccacgccugauuuaccucgcccuccaccacaucgugaaguaccggggcaacuuccuguacgaggggcagaaguucaacauggaugccuccaacaucgaggacaagcucagugacguguucacccaguuugccgauuucaacaacauccccuaugaggaugacgaaaagaagaaccuggagauccuggagauccucaagaagccccuguccaagaaggcgaaggucgacgagguaauggccuuaaucagcccggagaaggaguucaaguccgccuacaaggagcucgugacgggcaucgccgggaacaagaugaacgucaccaagaugauccugugcgagagcaucaagcagggagacuccgagaucaagcugaaguuuagcgacuccaacuacgacgaccaguucagcgaaguggagaacgacuugggggaguacguggaguucaucgacucccugcacaacauauacuccugggucgagcuccaaacaaucaugggcgccacccacacggacaacgcgagcaucuccgaggccauggugagccgcuacaauaagcaucaugaggaccuccaacugcugaagaagugcaucaaggacaacgugcccaagaaguacuucgacauguuccggaacgauuccgagaagguaaagggcuacuacaacuacaucaacagacccaauaaggcccccgucgaugaguucuacaaguucgugaagaagugcaucgaaaaggucgacaccccggaagccaagcagauccuccacgacauugagcuggagaauuuccugcucaagcagaacagccggaccaacggguccgugcccuaccagaugcagcuggacgagaugaucaagaucaucgacaaccaggcuaaguacuaccccgugcugaaggagaagcgcgagcagcuccugagcauccugaccuuccgcauccccuacuacuucggcccgcucaacgaaacguccgaacacgcauggaucaagcggcuggaggggaaggagaaccagcgcauccugcccuggaacuaccaggacaccgucgacguugacgccacggccgagggcuucaucaaacggaugcgcagcuacugcaccuacuuucccgacgaggaaguccuccccaagaacucccugaucgucucuaaguacgagguguacaacgaacugaacaagauccgggucgacgacaagcuccuggagguggacgugaagaaugacaucuacaacgagcuauucaugaagaacaagacagucaccgagaagaagcugaagaauuggcuugugaacaaccaaugcugccgcaaggacgccgagaucaaaggcuuccagaaagagaaccaguucuccaccagccugaccccauggaucgacuucacgaacaucuucgggaagaucgaccagucgaacuucgaccugaucgagaagaucaucuacgaccucaccguguucgaggacaagaagauaaugaagcggcgccugaagaagaaguacgcccugccagacgacaagaucaagcagauccucaagcugaaguacaaggacuggagccggcuguccaaaaagcuccuggacggcaucgucgcggacaaccgcuucggcagcuccgugaccgugcuggacguucucgagaugagccggcugaaccuaauggaaaucaucaacgacaaggagcucggcuaugcccagaugaucgaggaggccuccagcugcccuaaggacgggaaguucaccuaugaggagguggccaagcuggcgggcagcccugcgcugaagcgcggcaucuggcagucccuccagaucguggaggagaucacgaaggucaugaagugccggccgaaguacaucuacaucgaguucgagcgcagcgaggaggcgaaggagcggaccgaguccaagaucaaaaagcuggagaacguauauaaggaccuggacgaacagaccaagaaggaguacaaaagcgugcucgaggagcugaagggguucgacaacaccaagaagaucuccagcgacucccuuuuccucuacuucacgcagcugggcaagugcauguacagcgggaagaagcuggacaucgacuccuuggacaaguaccagaucgaccacaucgucccccaaagccugguaaaggacgacuccuucgacaaccgcgugcugguccuccccucagagaaccagcgcaaacuagacgaccugguggugcccuucgacauccgcgacaaaauguaccgguuuuggaagcuccuguuugaccacgagcugaucuccccgaagaaguucuacagccucauuaagaccgaguauaccgagcgcgacgaggagagauucaucaaccgucagcuggucgaaacacgccagaucacgaagaacgugacccagaucaucgaggaccacuacuccaccaccaagguggccgccauccgggcaaaccugagccacgaguuccgcgucaagaaccacaucuacaagaaccgugacaucaacgacuaccaccacgcccacgacgccuauaucguggcccucaucggcggguucaugcgcgaccgguaccccaauaugcacgacuccaaggccguguacagcgaguacaugaagauguuccgcaagaacaagaacgaccagaagaaguggaaggauggcuucgucaucaacagcaugaacuaucccuacgagguggacggcaagcugauauggaaucccgaccugaucaacgaaaucaagaagugcuucuacuacaaggacugcuacugcaccacgaagcucgaccagaaguccgggcagauguucaacuugaccgugcugccgaacgacgcgcacagcgccaagggcaccaccgaagccgucaucccugugaacaagaaccggaaggacgucaacaaguacgggggauuuuccggacuccaguaugucaucgccgcgaucgagggcacgaagaagaagggcaagaagcuggugaaggugcgcaagcugagcgggaucccccucuaccugaagcaggcggacauaaaggaacagaucgaguacguagagaaggaggagaaguuguccgacgugaagaucaucaaaaacaacaucccgcucaaccagcugauugagaucgacggccggcaguaccuucucaccuccccgaccgagugcguaaacgccaugcagcugguccugaacgaggaacaaugcaaacucauagccgacaucuacaacgccauauacaagcaggacuuugacgggcuggauaacaugcugaugauccagcucuaccugcaacugaucgacaagcucaagacccuguaccccaucuacaugggcauuguggagaaguucgagaagcugacugaggacuucguguccaucagcaaggaggaaaaggccaacgucaucaaacagaugcucaucaucaugcacaagggcccccagaacgggaacaucaucuacgacgacuucaacgugggcaagcgcaucggccggcugaacggccgcaccuucuaccuggacaacaucgaguucaucucccagagcccgaccgggaucuacaccaagaaguacaagcucuga

SEQ ID NO: 7591 - RNA, 4002 nt, Artificial Sequence
  Cas9 variant
auguacacguacuacuucaaagagagugagauggucuacgacguuggacuggacaucggcaccggcuccgugggguggguggcacuugacgaaaauggcaagcuagcacgcgcaaaggggaagaaccuggugggcgugcggcuguucgacacggcccagaccgccgccgaccgccggggcuuccgaaccacccggcgccgacugagucgccgaaaguggcgccugcgacuccuggacgaauuauuuuccgcugagaucaaugaaaucgacagcuccuucuuucaacgccucaaguacagcuacgugcaccccaaggacgaggagaacaaggcgcacuacuacgggggcuaccuauucccgacggaggaggagaccaagaaguuccacagguccuaccccaccaucuaccaccuccgccaggaguugauggcgcagcccaacaaaagauucgacauccgcgagaucuaccuagccauccaccacuuggucaaguacagagggcauuuccucucaucccaagaaaagaucacgaucggcagcacguacaaccccgaggaccuggccaaugcgaucgagguguacgccgacgagaagggccuauccugggagcucaacaacccggagcagcugaccgagaucaucagcggugaggccggcuacgggcugaacaaguccaugaaagccgacgaggcccucaaacucuucgaguucgacaacaaccaggacaagguggccaucaagacccuccucgccggccucaccgggaaccaaaucgauuucgccaagcuguucggcaaggacaucagcgacaaggacgaggcgaagcucuggaagcugaagcuggaugacgaggcccucgaggaaaagagccagacgauccugagccagcugaccgacgaggagaucgaacuguuccacgcggucgugcaggccuacgacgguuucguguugaucgggcugcuaaacggcgcugacuccguuagcgccgccaugguccagcuguacgaccagcaccgggaggacagaaagcugcucaagucccuggcccaaaaggcugggcugaagcauaagcgcuucagcgagaucuacgagcagcuugcccuggccaccgaugaggccaccaucaagaacggcaucagcacagcgcgggaacugguggaggaguccaaccucagcaaggaggucaaggaggacaccuuacggagacuggacgaaaacgaguuccucccgaagcaacggaccaaggcaaacucagugaucccccaccagcuucauuuagccgagcugcagaagauacuccagaaccagggucaguacuaccccuuccugcuggacaccuucgaaaaggaggacggccaggacaacaagaucgaggagcucuugcgcuuccggauuccguacuacguggguccccuggucacgaagaaagauguggaacacgccgggggcgacgcugacaaccacuggguggagcgcaaugagggguucgaaaaaucccgggucacccccuggaacuucgacaagguguucaaccgagacaaggccgcccgggacuucauugaacgacucaccgggaacgacaccuaccugaucggggagaagacgcugccccaaaacagccucagauaccagcuguuuaccgugcugaacgagcuuaacaacguccgcgugaauggcaagaaguucgacagcaaaacaaaggccgaccugaucaacgaucuguucaaggcucggaagaccgucucccucagugcgcugaaggacuacuugaaggcccagggcaagggugacgucacgauaaccgggcucgccgaugagucgaaguucaacagcucccuuuccagcuacaacgaccugaagaagaccuuugacgccgaguaccucgagaacgaggacaaccaggagacgcuggaaaagaucaucgagauccaaacgguguucgaagacucgaagaucgccucccgcgagcugagcaaguuaccgcuugacgacgaccagguuaaaaagcucucccaaacccauuauaccggguggggccggcucucagagaagcugcuggacuccaagauuaucgacgagcgcgggcagaaaguaaguauauuggauaaguuaaaaagcacgucccagaacuucaugagcaucaucaacaacgauaaguacggcgugcaggcguggaucacugaacagaauaccggcuccagcaagcugaccuucgacgagaaggucaacgagcucaccacauccccagcaaacaaacggggaauuaagcagagcuucgccguacugaacgacaucaagaaggccaugaaggaggagccccgccggguguaccuggaguucgcgcgcgaggaccagacauccgucaggagcgugccccgcuauaaccaacucaaggagaaguaucaguccaagagccuguccgaggaagcgaaagugcugaagaagacucucgacggcaauaagaacaagaugagcgacgaccgcuacuuccuguacuuccagcaacaggggaaggacauguacacgggacggccgaucaacuucgagcgcuugucccaggacuacgacaucgaccacaucaucccccaggccuucaccaaagacgauagccucgacaauagaguucuggugucccgccccgagaacgcccgaaagucagacuccuucgcuuacaccgacgaggugcagaagcaggacgggucccuauggaccagccuucugaaguccggguucaucaaccgcaagaaguacgagcggcugaccaaggcuggcaaguaccucgacgggcagaagaccggcuucaucgcccgacagcuggucgaaacgcggcagaucauaaagaacguagccagccugaucgagggcgaauacgaaaacuccaaggccguggccauacguagcgaaaucaccgcggacaugcggcuccuggugggcaucaagaaacaccgcgagaucaacuccuuccaccacgcguucgacgcccugcucaucaccgccgccggccaguauaugcaaaaccgguaccccgacagagacucuaccaauguguauaacgaguuugaccgguacacgaaugacuaccuuaagaaccugaggcaacucuccagccgagaugaggugcgccgacuuaaguccuucggguucgucgugggcacaaugcgcaagggaaaugaggacuggagcgaggagaacaccucguaccuucggaagguaaugauguucaagaauauccucaccacgaagaagaccgaaaaggaucggggaccgcugaauaaggagaccaucuucagccccaagucggggaagaagcuaauuccccucaacagcaagcgcuccgacaccgcgcuguacggcggcuacagcaacgucuacuccgccuacaugacacuggugcgcgccaacgggaagaaccuccuuaucaaaauccccaucagcaucgcaaaccaaaucgaggugggaaaccugaagauuaacgacuauaucgucaacaauccggcuauaaagaaguucgagaagauccucauaucuaaauuaccccuggggcagcucgugaacgaagauggcaaccugaucuaccuggccagcaaugaguaccgccacaacgcuaagcagcucuggcugagcaccaccgacgccgacaaaaucgcaucuauuagcgaaaacuccagcgacgaggagcugcucgaggcguacgacauccugacaucugagaacguuaagaaccgguuccccuuuuucaagaaggacaucgacaaacuuucgcagguccgcgacgaguuccuagauuccgacaaacggaucgccgugauccagacgauccugcgugggcugcaaauugacgccgccuaccaggcgcccguuaagaucauaagcaagaaggucuccgacuggcacaagcuccaacagagcggcggcaucaagcucuccgacaacagcgagaugaucuaccagucggcgacagggaucuucgagaccagagugaagaucucugaccugcucuga

SEQ ID NO: 7592 - RNA, 4005 nt, Artificial Sequence
  Cas9 variant
augaaaaaccccuacaccaucggccuggacaucgggaccaacagcgugggcugggccguccucacgaaccaguacgaccuggugaagcgcaagaugaagguggcagggaacuccgacaagaagcagaucaagaagaacuucuggggcguccggcuguucgacgacgggcagacagcgguggaccgccggaugaaccgcacagcccggcgccggaucgaacgccggcgcaaccggauaagcuaccuccaggagaucuucgccguggagauggccaacaucgacgccaacuucuucugcagacugaacgacuccuucuacguagacagcgagaagcggaacucccgccacccguucuucgcgaccaucgaggaggagguggccuaccacaagaacuaccggacgauauaccaccuccgcgaggagcucgugaacagcucugagaaggccgaccugcggcuggucuaccucgcccuggcgcacaucauuaaguaccgcgggaacuuccugaucgagggcgcccucgacaccaagaacaccagcguggacgggguguacgagcaguucauccagaccuacaaccaggucuucauguccaacaucgaggagggcacgcuggccaaaguggaggagaacaucgagguggcgaacauccuggccgggaaguucacccggcgcgagaaguucgagcggauacuccagcuguaccccggcgagaagucaaccgggauguucgcgcaguucaucagccugaucgucggcagcaagggcaauuuccagaagguauucgaccucaucgagaagaccgacaucgagugcgccaaggacagcuacgaggaggaccuggaggcgcugcucgccaucaucggggacgaguacgccgagcuguucguggcggccaagaacacguacaacgccgucgugcucagcuccaucaucaccgugaccgccaccgagacgaacgccaagcucagcgcguccaugaucgagcgcuucgacgcccacgagaaggaccugggcgagcugaaggccuucaucaagcuccaccuccccaagcaguaccaagagaucuucaacaacgccgcuaucgacggguacgcgggcuacaucgacggcaaaaccaagcaggucgauuucuacaaguaccugaagaccauccucgagaacauugagggugcggacuacuucaucgccaagaucgaggaggagaacuuccugcgcaagcagcggaccuucgacaacggcgccaucccccaccagcuucaccucgaggagcuggaggcgaucauccaccagcaggccaaguacuacccguuccugcgcgaggacuacgagaagaucaagagccucgucacguuccggauccccuacuucguggggccccuggccaaaggccaguccgaguucgccuggcugacccgcaaggccgacggggagaucaggcccuggaacaucgaggagaaggucgacuucggcaagagcgcgguggacuucaucgaaaagaugacgaacaaggacaccuaccucccgaaggagaacguccuacccaagcacagccuuugcuaccaaaaguacaugguguacaacgagcucacgaaggugcgcuacaucgacgaccagggcaagaccaacuacuucuccgggcaggaaaagcaacagaucuucaacgaccuguucaagcagaagcggaaggucaagaagaaggaccuggagcuguuccugcgcaacaucaaccacaucgagagccccaccaucgagggccuggaggacuccuucaacgccagcuacgccaccuaccacgaccuccugaagguggggaugaagcaggagauccuggacaacccccugaacacggagaugcuugaggacaucgugaagauccugaccgucuucgaggacaagccgaugaucaaggagcagcugcagcaguucuccgacgugcucgacggcggggugcugaagaagcuggagcggcgccacuacaccggcuggggccggcucagcgccaagcugcuggucgggauccgcgagaagcagucccaccucaccauccuggacuaccugaugaacgacgacggccucaaccggaaccugaugcagcugauuaacgacagcaaccucuccuucaagagcaucaucgagaaggagcaggucuccacgaccgacaaggaccugcagagcaucguggccgaccuggcggggucccccgccaucaagaagggcaucuugcagagccugaagaucgucgaugagcucguguccaucaugggguacccgccccagaccaucguggucgagauggcccgcgagaaccagaccacaggcaagggcaagaacaacagcaagccccgguacaagucccucgagaaggccaucaaggaguucgggagcaagauccugaaggaacacccgaccgacaaccaggaacugaagaacaaccgccucuaccuguacuaccugcagaacggcaaggacauguacaccgggcaagagcucgacauccacaaccuguccaacuacgacaucgaccacaucgugccccagagcuucaucaccgacaacagcaucgacaaccuggugcucaccuccagcgccggcaaccgggagaagggaggggacgugcccccgcuugagauagugcgcaagcggaagguguucugggagaagcuguaccagggcaaccucauguccaagcgcaaguucgacuaccugacgaaggcggagcgcgggggccugaccgacgccgacaaggccagguucauccaccgccagcucgucgagacccggcagaucacgaagaacguggcaaacauccugcaccagcgcuucaacaacgagacggacaaccacgggaacaccauggagcagguccggaucgugacccuaaagagcgcgcuggugucacaguuccgcaagcaguuccaacuguacaaggugcgggaggucaacgacuaucaccacgcccacgacgccuaccugaauggcgugguggccaacacccuccuaaaggucuacccccagcuggagcccgaguucguguacggcgaguaccaccaguucgacugguuuaaggccaacaaggcgacugccaagaagcaguucuacaccaacaucaugcuguucuucgggcagaaggagcgcaucaucgacgaaaacggcgagauccugugggacaagaaguaccuggagaccaucaagaaggugcucgauuaccggcagaugaacaucgucaagaagaccgaaauccagaagggggaguuuucgaaggccacgaucaagcccaagggcaacuccagcaaacugaucccgcgcaaggagaacugggaccccaugaaguacgggggccuggacucccccaacauggccuacgcugugaucaucgagcacgcgaagggcaagaagaagcucaucuucgagaagaagaucauccggaucaccaucauggagcgcaagauguucgagaaagaugaggaggccuucuuagaggaaaagggguaccggcaccccaaggugcugaccaagcucccgaaauacacccuguacgaaugcgagaagggccgccggagaaugcuggccagcgccaacgaagcccagaaggggaaccagcucguccuguccaaccaccuggugagucuccuguaccacgcgaagaacugcgaggccuccgacggcaagagccugaaguacaucgaggcccaccgggagacguucagugaacuccuggcccaggugagcgaguucgcgacccgcuacacccuggccgacgccaaccucuccaagaucaacaaccuguucgagcagaacaaggagggagacauccaggccaucgcccagagcuucgucgaccugauggcguucaacgccaugggcgcccccgccagcuucaaguuuuucgaggccacgaucgaccggaagcgcuacacgaaccucaaggagcugcuguccagcaccaucaucuaccaguccaucaccggccucuacgagagccggaagcgccuggacgacuga

SEQ ID NO: 7593 - RNA, 4005 nt, Artificial Sequence; identical to SEQ ID NO: 1793
  Cas9 variant

SEQ ID NO: 7594 - RNA, 4005 nt, Artificial Sequence; identical to SEQ ID NO: 1794
  Cas9 variant

SEQ ID NO: 7595 - RNA, 4005 nt, Artificial Sequence; identical to SEQ ID NO: 1795
  Cas9 variant

SEQ ID NO: 7596 - RNA, 4005 nt, Artificial Sequence
  Cas9 variant
augaagaacccauacaccaucggccuggacauagggaccaacagcgugggaugggccgucuugacggaccaguaugaccugguuaagcgcaagaugaagguggccgggaacuccgacaagaagcagaucaaaaagaacuucuggggaguccggcuguucgacgagggggagaccgcagccgacagacggaugaaccgcaccgcgcggaggcggaucgaacgccggcgcaaccggaucagcuaccuccaggagaucuucgcccuggagauggcuaacaucgacgcgaauuucuucugccgccugaacgacuccuucuacguagacagcgagaagcggaacucccgccacccguucuucgcgaccaucgaggaggagguggccuaccauaagaacuaccgcacgaucuaccaccuccgcgaggagcuggucaacagcucagagaaggccgaccugcggcucguguaccuggcgcucgcccacaucaucaaguaccgcggcaacuuccuaaucgagggcgcccuggacaccaagaacaccagcguggacggggucuacaaacaguucauccagaccuacaaccagguguucauuuccaacaucgaggagggcacgcuggccaaaauggaggagaacaccaccguggccgacauacuugcggggaaguucaccagaaaggagaagcuggagcgcauccugcagcucuaccccggcgagaaguccacggggauguucgcccaguucaucagccugaucgucggcagcaagggcaacuuccagaagguguucgaucugguggagaagaccgacaucgagugcgccaaggacuccuaugaggaggaccucgaggcccugcuggccaucaucggggacgaauacgcggagcuguucgucgccgccaagaacaccuauaacgccguggugcucagcuccaucaucacaguaacggacaccgagaccaacgccaaacugagcgcguccaugaucgagcgguucgacgcccacgagaaggacuuaagggagcugaaggccuucauaaagcugcaucuucccaagcaguacgaggagaucuucagcaacguggccaucgacggcuacgcuggguacaucgacggcaagaccaagcaggucgacuucuacaaguaccugaagacgcugcucgagaacaucgagggcgcggauuacuucaucgccaagaucgaggaggagaacuuccugcgcaagcagcggaccuucgacaacggggccaucccccaccagcugcaccucgaggagcuggaggccauccugcaccaacaggcgaaauacuacccguucuucaaggaggccuaugauaagaucaagucccucgugacauuccgcauccccuacuuugugggcccccuggccaaugggcagagcgacuucgccuggcugacccggaaggccgacggcgagauccgccccuggaacaucgaggagaagguggacuucggcaagagcgcugucgacuucaucgagaagaugacuaacaaggacaccuaccucccgaaggagaaugugcugcccaagcacucccuguacuaccagaaguacauggucuacaacgaacuaaccaagguaagauacaucgacgaccaggggaagaccaacuauuucagcggccaggagaagcagcagaucuucaacgacuauuucaagaaaaagcgcaagguguccaagaaggacuuagagcaguuccugcggaacaugucucacaucgagucccccacgaucgaggggcucgaggacagcuucaacuccagcuacgcaaccuaccacgaccugcugaaggucgguaucaagcaggaggugcuggaaaacccccucaacaccgagaugcuggaggacaucgugaaaauccugaccgucuucgaggacaagcgcaugaucaaagagcagcuccagcaguucuccgacguucuggacggggccgugcugaagaagcucgagcggcgccauuacacgggcuggggucggcugagcgccaagcugcuagucggcauccgcgacaagcagucccaccugaccauccuggauuaccucaugaaugacgacggccugaaccgaaaccugaugcagcucauaaacgacagcaaccugucuuucaagagcaucaucgaaaaggagcaggucuccaccaccgacaaggaucugcagagcaucguggccgaccucgcgggguccccggccaucaagaagggcauccugcagagccugaagaucguugacgagcucguguccauaaugggguacccgccacagacgaucguggucgagauggcccgcgagaaccagaccaccgugaagggcaagaacaacagccggccccguuacaagagccuggagaaggccaucaaggaguucgggucccagauccugaaggagcaucccaccgacaaccaggagcuccggaacaaccgccuguaccuguacuaccuccagaacggcaaggacauguacaccggccaagagcuggacauccacaaccugucaaacuacgauaucgaccacaucgugccccaguccuucaucacggacaacagcaucgacaaccuggucuugaccuccagcgccgggaaccgggagaaaggcgacgacgugccgccccuggagauagugcgcaaacgcaaggucuucugggagaagcuguuccaggggaaccucauguccaagcggaaauucgacuaccuaaccaaggcggagcgcggcggucucacggaggccgacaaggcaacuuucauccaccggcagcugguggagacccgccagaucaccaagaacguggccaacauccugcaccagcguuucaacaaugagacagacaaccacgggaacaacauggagcagguccgcaucgugaugcucaagagcgcccuggugucccaguuccggaagcaguuucaacuguacaagguccgcgaggugaacgacuaccaccacgcccacgacgccuaccucaacggcguggucgccaacacgcugcugaagguguacccccagcucgagcccgaguucguauacggggaguaccaccaguucgacugguucaaggccaacaaggcuaccgccaagaagcaguucuacaccaacauuaugcuguucuucgcccagaaggagcggaucaucgacgagaacggcgaaauccugugggacaagaaauaccucgagaccaucaagaagguccuggacuaccgccagaugaacaucgugaagaagacggagauccagaagggggaguucagcaaggccaccaucaagcccaaaggcaacuccagcaagcucaucccccggaaggagaacugggacccgaugaaguacggcgggcucgacuccccuaacauggcauacgcggugaucaucgagcacgccaagggcaagaagaaggucguuuucgagaagaaaaucauccgcauaaccaucauggagcggaaggccuuugagaaggaugagaaguccuuuuuagaaaagcagggguaccgccaacccaaggugcugacaaaacuccccaaguacacgcuguacgagugcgagaauggccggcgccggauguuagccagcgccaacgaggcgcagaaagggaaccagcagguccucaagggccaacugaucacccugcuccaccacgccaagaacugcgaggccagcgacggcaagucccuggacuacaucgagagcaaccgcgaaauguucggggagcugcucgcccacgugagcgaguucgcgaagcgguacacccuggcagacgccaaccuguccaagaucaaccaguuauucgagcagaacaaggauaacgacaucaaggugaucgcccagagcuucgugaaccucauggccuucaacgcaaugggcgccccggccuccuuuaaguucuucgaggccaccaucgaacgcaagcgguacacgaaccuuaaagagcuccugagcgccaccaucaucuaccaguccauuaccgggcuguacgaagcgcgcaagcgccucgacggcuga

SEQ ID NO: 7597 - RNA, 4005 nt, Artificial Sequence; identical to SEQ ID NO: 1797
  Cas9 variant

SEQ ID NO: 7598 - RNA, 4005 nt, Artificial Sequence
  Cas9 variant
augaagaaccccuacaccaucggccuggacaucgggacaaacagcgugggcugggcuguccucacggaccaguacgaccuggugaagcgcaagaugaagguggccgggaacuccgacaaaaagcagaucaagaagaacuucuggggcguccggcuguucgacgagggggagaccgcggccgaccgccggaugaaccgcaccgcucggcgccggaucgagcgccggcgcaaccgaaucagcuaccuccaggagaucuucgcucuagagauggccaauaucgacgcgaacuucuucugccgccugaacgacuccuucuacguggacagcgagaagcggaacucccgccacccguucuucgccaccaucgaggaggagguggccuaccacaagaacuaccggacgaucuaccaccuccgcgaggagcuggucaacagcuccgagaaggccgaccugcggcucguguaccuggcgcuggcccacauuaucaaguaccgcggcaacuuccucaucgagggcgcccuggacaccaagaacaccucuguggacggggucuacaagcaguucauccagaccuacaaccaaguguucaucuccaauaucgaggagggcacgcuggccaagauggaggagaacaccaccguggccaacauccucgcggggaaguucacccguaaggagaagcuggagcgcauccugcaacucuaccccggcgagaaguccacggggauguucgcccaguucaucagccugaucgucgggagcaagggcaacuuccagaagguguucgaccuaguggagaagaccgacaucgagugcgccaaagacuccuacgaggaggaccucgaggcccugcuggccaucaucggggacgaguacgcggagcuguucgucgccgccaagaacaccuacaacgccguggugcucagcuccaucaucaccgucacggacaccgagaccaacgccaagcugagcgcgaguaugaucgagcgauucgacgcccacgagaaggaccucagcgagcugaaggccuucaucaagcugcaccuccccaagcaguacgaggagaucuucuccaacguggccaucgacggcuacgccggcuacaucgacggcaagaccaagcaggucgacuucuacaaguaccugaagacgcugcucgagaacaucgagggcgcggacuacuucaucgccaaaaucgaggaggagaacuuccugcgcaagcagcgcaccuucgacaacggggccaucccccaccagcugcaccucgaggaacuggaggcuauucugcaccagcaggcgaaguacuacccguuccucaaggaggccuacgacaagaucaagagccuagugaccuucaggauacccuauuuugugggcccccuggcaaacgggcagagcgacuucgccuggcucacccgcaaggccgacggcgagauccggcccuggaacaucgaggagaagguugacuucgggaaguccgcggucgacuucaucgagaagaugacgaacaaggacaccuaccugccgaaggagaacguccugcccaagcauagccucuacuaccagaaguacauggucuacaacgagcugaccaaggugcgcuacaucgacgaccagggcaagaccaacuacuucaguggacaggagaagcagcagaucuucaacgacuacuucaagcagaagcggaaggugagcaagaaggaccuggagcaguuccugcguaacaugucccacaucgagagccccacgaucgaggggcuggaggacuccuucaacagcuccuacgccaccuaccacgaccugcugaaggucggcaucaagcaggaggugcucgagaacccccugaacauggagaugcuggaggacaucgugaagauccucaccgucuucgaggacaagcggaugaucaaggagcagcugcagcaguucagcggggugcuggacggagccgugcucaagaaguuggagcgccggcacuacaccggguggggccgccucuccgccaagcuccuggucggcauccgggacaagcagagccaccugacgauccucgacuaccugaugaacgacgaugggcugaaccgcaaccucaugcagcugauaaacgacuccaaccuguccuucaaguccaucaucgagaaggagcaggucagcaccaccgacaaggaccuccaguccaucguggccgaccuggcgggcagcccggccauuaagaaggggauccugcagucccucaagaucgucgacgagcuggugagcaucaugggcuacccgccccaaaccaucguggucgagauggcgcgggagaaccagacgaccgugaaggggaagaacaacagccgcccccgguacaagucccucgagaaagccaucaaggaguuuggcagccagauccucaaggagcaccccaccgacaaccaggaacugcgcaacaaccggcuguaccucuacuaccugcagaacggcaaggacauguacaccgggcaggagcuggacauacacaaccucuccaacuacgacaucgaccacaucgugccacagagcuucaucaccgacaacuccaucgacaaccugguccugacgagcuccgccggcaaccgcgagaagggggacgacgugccgccccucgagaucgugagaaagcgcaaggucuucugggagaagcuguuccagggcaaccugaugagcaagcgcaaguucgacuaccuuaccaaggcggagcggggcgggcugaccgaggccgacaaggccaccuucauccaccgccaguugguggagacgcggcagaucaccaagaacguggccaacauccuccaccagcgcuucaacaacgagaccgacaaccauggcaacaacauggagcagguccggaucgugaugcugaaguccgcgcuggugagccaguuccgcaagcaguuccaguuauacaagguccgggaggugaacgacuaccaccacgcgcacgacgccuaccugaacgggguggucgccaacacccugcucaagguguacccccaacuggagcccgaguucguguacggcgaguaccaccaguucgacugguucaaggccaacaaggcgaccgccaagaagcaguucuacacuaacaucaugcuguucuucgcccagaaggagcgcaucaucgacgagaauggugagauccucugggacaagaaguaccuggagaccaucaagaagguccuggacuaccggcagaugaacaucgugaagaagaccgagauccagaagggcgaguucuccaaggccacgaucaagcccaagggcaacagcuccaaacuuaucccccgcaaggagaacugggacccgaugaaguacgggggccuggacagcccuaacauggccuacgcggugaucaucgagcacgccaaggggaagaagaagaucgucuucgagaagaagauaauacggaucaccaucauggagcgcaaggccuucgaaaaggacgagaaguccuuccuggagaagcagggcuaccggcagcccaaggugcucaccaagcugccgaaguacacccuguacgagugcgagaacgggcgccgucgcaugcucgccagcgccaacgaagcgcagaagggcaaccagcagguccugaagggccagcugaucacgcuccugcaccacgccaagaacugcgaggccuccgacggcaagagccuggacuacaucgagagcaaccgcgagauguucggggagcuccuggcccacgugagugaguucgcgaagcgcuacacccuggccgacgccaaccucucuaagaucaaccagcuguuugagcagaacaaggacaacgauaucaaggugaucgcccagagcuuuguuaaccugauggccuuuaacgcgaugggggccccggccagcuucaaguucuucgaggccaccaucgagcggaagcgcuacaccaaccucaaggagcugcugcgggccacgaucaucuaccaguccaucaccggccucuaugaggcgcgcaagcgccuggacggguga

SEQ ID NO: 7599 - RNA, 4005 nt, Artificial Sequence
  Cas9 variant
augaagaaccccuacaccaucggccuggacaucggcaccaacucugugggcugggccguccucacggaccaguacgaccuggugaagcgcaagaugaagguggccgggaacuccgacaagaagcagaucaagaagaacuucuggggcguccggcuguucgacgagggggagaccgcggccgaucgccggaugaaccgcaccgcccggcgccggaucgagcgccggcgcaaccggaucagcuaccuccaggagaucuucgcccuagagauggccaacaucgacgcgaacuucuucugucgccugaacgacuccuucuauguggacagcgagaagcggaacucccgccacccguucuucgccaccaucgaggaggagguggccuaccacaagaauuaccggacgaucuaccaccuccgcgaggagcuggucaacagcucugagaaggccgaccugcggcucguguaccuggcgcuggcccacaucaucaaguaccgcgggaacuuccucaucgagggcgcacuggacaccaagaacaccagcguggacggggucuacaagcaguucauccagaccuauaaccagguguucaucuccaacaucgaggagggcacgcuggccaagauggaggagaacaccaccguggccgacauccucgcggggaaguucacacggaaggagaagcuggagcgcauccugcagcuuuaccccggcgagaaguccacggggauguucgcccaguucaucagccugaucgucggcagcaagggcaacuuccagaagguguucgaccugguggagaagaccgacaucgagugcgccaaggacuccuacgaggaggaccucgaggcacugcuggcaaucaucggggacgaguacgcggagcuguucgucgccgccaagaacaccuacaacgcaguggugcucagcuccaucaucaccgucacggacacagagaccaacgccaagcugagcgcguccaugaucgagcgcuucgacgcccacgagaaggaccucagcgagcugaaggccuucaucaagcugcaccuccccaagcaguacgaggagaucuucuccaacguggccaucgacggcuacgcaggguacaucgacggcaagaccaagcaggucgacuucuacaaguaucugaagacgcugcucgagaauaucgagggggcagacuacuucaucgccaagaucgaggaagagaauuuccugcgcaagcagcgcaccuucgacaacggggccaucccccaccagcugcaccucgaggagcuggaggccauccugcaccagcaggcgaaauacuacccguuccucaaggaggccuacgacaagaucaaaagccuggugaccuucaggauccccuacuucgugggcccccuggccaacgggcagagcgacuucgccuggcucaccaggaaggccgacggcgagauccggcccuggaacaucgaagagaagguggacuucgggaaguccgcggucgacuucaucgagaagaugaccaacaaggacaccuaccugccgaaggagaacgugcugcccaagcacagccucuacuaccagaaguacauggucuacaacgagcugaccaaggugcgcuacaucgacgaccagggaaagaccaacuacuucuccggccaagagaagcagcagaucuucaacgacuacuucaagcagaagcggaaggugagcaagaaggaccuggagcaguuccuccgcaacaugucccacaucgagagccccacgaucgaggggcuggaggacuccuucaacagcuccuacgccacguaccacgaccugcugaaagucggcaucaagcaggaggugcucgagaacccccugaacaccgagaugcuggaagacauugugaagauccucaccgucuucgaggacaagcggaugaucaaggagcagcuucagcaguucagcgaugugcuggacggggccgugcucaagaagcucgagcgacggcacuacacgggcugggggcgccuguccgccaagcuccugguggggauccgggacaagcagagccaccugaccauccucgacuacuugaugaacgacgacggccugaaucgcaaccucaugcagcuuaucaacgacuccaaccugagcuucaagagcaucaucgagaaggagcaagucucaaccaccgacaaggaccuccaguccaucguggccgaccuggcggggagcccggccaucaagaagggcauccugcagagucucaagaucguggacgaacuggugagcaucaugggguacccgccccagacgaucguggucgagauggcccgggagaaccagaccaccgugaagggcaagaacaacagccgcccucgguacaagucccuggagaaggccaucaaggaguucgggagccagauccucaaggagcaccccaccgacaaccaggagcugcgcaacaaccggcuguaccucuacuaccugcagaauggcaaggacauguacaccggccaggagcuggacauccacaaccucuccaacuacgacaucgaccacaucgugccgcagagcuucaucacggacaauuccaucgacaaccugguccugaccagcuccgccgggaaccgcgagaagggcgacgacgugccgccccucgagaucgugcggaagcgcaaggucuucugggagaagcuguuccaagggaaccugaugagcaagcgcaaguucgauuaccuuaccaaggcggagcggggcggccugaccgaggccgacaaggccacguucauacaccgccagcugguggagacccggcaaaucaccaagaacguggccaacauccuccaccagcgcuucaacaacgagaccgacaaccacgggaacaacauggagcagguccggaucgugaugcugaaguccgcgcuggugagccaguuccgcaagcaguuccagcucuacaagguccgggaggugaacgacuaucaccacgcucacgacgccuaccugaacggcgugguugccaacacgcugcucaagguguacccccagcuggagcccgaguucguguacggggaguaucaccaguucgacugguucaaggccaacaaggcgaccgccaagaagcaguuuuacaccaacaucaugcuguucuucgcccagaaggagcgcauaaucgacgagaacggcgagauccucugggacaagaaguaccuggagaccaucaagaagguccuggacuaccggcagaugaacaucgugaagaagacggagauccagaagggggaguucuccaaggccaccaucaagcccaagggcaacagcaguaagcucaucccccgcaaggagaacugggacccgaugaaguacggcgggcuggacagccccaacauggccuacgcggugaucaucgagcacgccaagggcaagaagaaggucguguucgagaagaagaucauccggaucaccaucauggaacgcaaggccuucgagaaggacgagaaguccuuccuagagaagcagggguaccggcagcccaaggugcucaccaagcugcccaaguacacgcuguacgagugcgagaacgggcggcgccgcaugcucgccagcgccaacgaggcccaaaaggggaaccagcagguccugaagggccagcuaaucacccuccugcaccacgccaaaaacugcgaagccuccgacggcaagagccuggacuacaucgagagcaaccgggagauguucggugagcuccuggcccacguguccgaguucgcuaagcgcuacacccuggccgacgccaaccucagcaagaucaaccagcuguucgagcagaacaaggacaacgacaucaaggugaucgcccaguccuucgucaaccugauggccuucaacgcgaugggcgccccggccagcuucaaguucuucgaggccaccaucgagcggaagcgcuacacgaaccucaaggagcugcuguccgccacaaucaucuaccagagcaucaccgggcucuacgaagcgcggaagcgccuggacggcuga

SEQ ID NO: 7600 - RNA, 4005 nt, Artificial Sequence
  Cas9 variant
augaagaaccccuacaccaucggccuggacaucgggaccaacagcgugggcugggccguccucacgaaccaguacgaccucgugaagcgcaagaugaagguggccggcaacuccgacaagaagcagaucaagaagaacuucuggggcguccgguuauucgacgacgggcagaccgcgguggaccgccggaugaaccgcaccgcccggcgccggaucgagcgccggcgcaaccggaucagcuaccuccaggagaucuucgccguggagauggccaacaucgacgccaacuucuucugcagacugaacgacuccuucuacgucgacagcgagaagcggaacucccgccacccguucuucgcgaccaucgaggaggagguagccuaccacgacaacuaccggacgaucuaccaccuccgcgaggagcugguaaacagcuccgagaaggccgaccugcggcugguauaucucgcccuggcccacaucaucaaguaccgcggcaacuuucugaucgagggcgcccucgacacgaagaacacgagcguggacgagguauacaagcaguucauccagaccuacaaccaggucuucauguccaacauugaggagggggcccuggccaagguggaggaaaaccuggagguggcaagcauccucgcgggcaaguucacccggcgcgagaaguucgagcggauccugcgccuguaccccggggagaaguccaccggcauguucgcccaguuuaucagccuaaucgucgggaacaagggcaacuuccagaagguguucaaccugguggagaagaccgacaucgagugcgccaaggacuccuacgaggaggaccuggaggcccuccuggccaucaucggcgacgaguacgcggagcuguucgucgccgccaagaacaccuacaacgccguggugcucagcuccaucaucacggucaccgccaccgagaccaacgcgaagcugagcgccuccaugaucgagcgcuucgacgcccacgagaaggacuuaggggagcuuaaggccuucaucaagcugcaccuccccaagcaguaccaggagaucuucaacaacgccgcgaucgacggauacgccggguacaucgacggcaagacgaagcaggucgacuucuacaaguaccugaagaccacccuggagaacguggagggcgccgacuacuucaucaccaagaucgaggaggagaacuuccugcggaagcagcgcacguucgacaacggggugaucccacaccagcuccaccuggaggagcuggaggccauccuccaccagcaggcgaaguacuacccguuccugcgggaggacuacgagaagaucaagagccuggugaccuucagaauccccuacuucgucggcccccucgccaaggggcaguccgaguucgccuggcugacccggaaggccgacggcgagauccgccccuggaacaucgaggagaagguggacuucggcaagucagccguggacuucaucgagaagaugaccaacaaggacacguaccuuccuaaggagaacguccuacccaagcacagccugugcuaccagaaauacaugguguacaacgagcugaccaaggugcgguacaucgacgaccaggggaagaccaacuacuucuccggccaggagaagcagcagaucuuuaacgaccucuucaagcagaagcgcaaggucaagaagaaggaccuggagcuguuccuccggaacaucaaccacaucgagagccccacuaucgaggggcuggaggacuccuucaacgcgagcuacgccacguaccacgaucugcugaaggugggcaugaagcaggagucccucgacagcccccugaaugccgagaugcuggaggacaucgugaagauccucaccgucuucgaggacaagcgcaugaucaaggagcagcugcagcaguucuccgacgugcuggacggggugguccucaagaagcuggagcggcgccacuacaccggcugggggcggcugagcgccaagcuccuggugggcauccgggacaagcaaucccaccugaccauccucgacuaucucaugaacgacgacggccugaaccggaaccucaugcagcugaucaacgauagcaaccuguccuucaagagcaucaucgagaaggagcaggucuccacgaccgacaaagaccuccagagcaucguggccgaccuggcgggguccccggccaucaagaagggcauucugcagagccucaagaucguggacgagcugguguccaucaugggguacccgccccagaccaucgucguggagauggcccgcgagaaucagaccacggugaagggcaagaacaacagccggccccgcuacaagucccuggagaaggcgaucaaggaguucgggagccagauccucaaggagcaccccaccgacaaccaggagcugaaaaacaaccggcuguaccucuacuaccugcagaacggcaaagacaucuacaccggccaggagcuggacauccacaaccucucuaacuacgacaucgaccacaucgucccccaguccuucaucaccgacaacagcaucgacaaccuggugcugaccuccagcgccgggaaccgcgagaagggcggggacguaccgccccucgagaucguccgcaagcggaagguguucugggagaagcuguaccaggggaaccugauguccaagcgcaaguucgacuaccucacgaaggcggagcggggcgggcugaccgacgccgacaaggccagguuuauccaccggcagcugguggaaacccgccagaucaccaagaacgucacgaacauccuccaccagcgguucaacaacgagaccgauaacuacggcaauaccauggagcagguccgcaucgugacccucaagagcgcccuggugucccaguuccggaagcaauuccagcuguacaaggugcgcgaggugaacgacuaccaccacgcgcacgacgccuaccugaacggggucguggccaacacguugcucaagguguacccccaguuggagcccgaguucgucuacggcgaauaccaccaguucgacugguucaaggccaacaaggccacugcgaagaagcaguucuacaccaacaucaugcuguucuucgcacagaaggagcggauaaucgaugagaacggggagauccucugggacaagaaguaccuggagaccaucaagaaggugcuugacuaccgacagaugaacaucgugaagaagacggagauccagaagggcgaguucagcaaggccaccaucaagcccaagggaaacuccagcaagcucaucccccggaaggagaacugggauccgaugaaguacggaggccuggacucccccaacauggccuacgccgucaucaucgagcacgcgaaggggaagaagaagaucgugaucgagaagaagcugauccagaucaacaucauggagcgcaagauguucgagaaggaugaggaggccuuccucgaggagaagggcuaccggcacccuaaggugcugaccaagcugcccaaguacacccucuacgagugcgaaaaagggcgccggcgcaugcuugccagcgccaacgaagcccagaagggcaaccaacugguccucuccaaccaccuggugagccugcuuuaccacgcgaagaauugcgaggccuccgacggcaagagccugaaguacaucgaggcccaccgugaagccuucuccgagcugcucgcccaggugagcgaguucgcgacgcgcuacacccuggccgacgccaaccugagcaagaucaauaaccucuucgagcagaacaaggagggggacaucaaggccaucgcgcaguccuucgucgaccugaugguguucaacgcaaugggggccccggccagcuucaaguucuucgaggccaccaucgaccggaagcgcuacaccaaccugaaggagcucuuauccagcacgauaaucuaccagucuaucaccgggcuguacgagagccgcaagcggcucgacgacuga

SEQ ID NO: 7601 - RNA, 4005 nt, Artificial Sequence
  Cas9 variant
augaagaaggaguacacuaucggccuggauaucgggaccaacagcguggggugggccguccucacggaaaacuacgaccuggugaagaagaagaugaagguuuacgggaacaccgagaccaaguaccugaaaaagaaccucuggggcguccggcuguucgacgagggggaaaccgccgcagaccggcgccugaagcggacgacccgccggcgcuacuccaggaggcgcaaccgcaucugccgccuucaagaccuuuucaccgaagagaugaaccagguggacgccaacuucuuccauagacugcaggagagcuucuuaguacccgacgagaaggaguucgagcggcaugccauauucggcaagauggaggaggagguuuccuauuaccgcgaguucccuacgaucuaccaccuccguaagcaucuggccgacacgagcgagcaggcugaccuccgccugguguaccuugcgcucgcccauaucgugaaguaccggggccacuuccugaucgaaggagagcugaauaccgaaaauucgagcgucuccgagaccuuccgcacuuucauccagguguacaaccagaucuuccgggagaacgaggugcccuuggccguccccgauaacaucgaggaguuauucuccgagaaagugucgcgggcccggaagguggaggcgauccuguccguuuacuccgaggagaaguccacgggcacucucgcccaguuccugaagcugaugguggggaaccaagggcgguucaagaagaccuucgaccucgaggaggacgggauuauccagauacccaaggaagaauacgaggaggagcuggagacccuccuggccaucaucggcgaugaguacgccgagaucuucagcgccaccaagagcguguacgaugcggucgcccugucugguauccuaagcguuacugacggggacaccaaggccaagcucuccgcuagcaugguggagcgcuacgaggcccaucagaaggaccuggugcaguucaagcaauucauccguaaggagcugccggagauguacgcccccaucuucagggacaacuccgugagcggcuacgccggguacguggagaacagcaaggucgugacccaggccgaguucuacaaguacaucaagaaggccaucgaaaagguucccggcgccgaauacuuccucgagaagauugagcaggagacguuccuggacaagcagcgaaccuucaauaacggcgugaucccccaccaaauccaccuggaggagcucgaggcgaucauccagaaacaggcuaccuauuauccguuccuggccgacaacaaagaggagaugaagcagcuggugacauuccgcauccccuacuacgucgggccgcucgccgacggaaacucccccuucgcauggcuggagcggaucaguuccgagccgauccgacccgggaaccuggcggaggugguggacaucaagaagucagccacgaaguucaucgagcggaugaccaacuucgacaccuaccuccccaccgagaagguccugcccaagcauuccaugauauacgagaaguacaugguguacaaugagcugacgaaggugagcuacgucgacgagcgcggcaugaaccagcgguucuccggggaggagaagaaacagaucguggaggaacucuucaagcagagcaggaaggugaccaaaaagcugcuggagaaguuccucuccaacgaguucggccuggucgacguggccaucaagggcaucgagaccucuuucaacgcaggauacgggacguaccacgacuuucugaagaucgggaucacgcgugagcagcuugacaaggaggagaacuccgagacccucgaggagaucgugaaaauucugaccgucuuugaggaccgcaagaugaucagggagcagcuuaagaaguacacauaccucuucgacgaggaggugcugaaaaagcuggagcgccggcacuacacgggcugggggcgcuuaagcgcgaaacugcuaaucggcaucaaagagaagcgcacccacaagaccauccucgacuaccugaucgaggacgacggcgggaagcagccgaucaaccgcaaccugaugcagcucaucaacgacuccgaucugagcuucaaguccgagaucgccgaggcgcaguccgacaugaauacugaagaccugcacgaggucguccagaaccucgccggcucccccgccaucaagaaagggauucugcagagucugaagaucguggacgagcucguggauaucaugggcuccuuacccaaaaacaucgucguggaaauggcacgggaaaaucaaaccacaagccgcgggcgcacgaacagcaacccccggaugaaggcccuggaggaggccaugcgcaaccuccggucgaaccuguugaaagaguacccgaccgacaaccaggccuugcagaacgaccgccuguaccuguacuaccuccaaaacggcaaggacauguacaccggccuggacuuaagccuccauaaccuguccagcuacgauauugaccacaucgugccccaguccuucacgaccgacaacagccuggacaaccgaguucucguguccagcaaagagaaccgcgggaaaaaggacgacgugcccuccaaggaggucguucagaagaacaucacccugugggaaacccugaagaacagcaaccucaucucccagaagaaguaugacaaccugacgaaaggccuccgcggagggcucaccgaggacgaccgggcccauuucaucaagcggcagcugguggagacccgccagaucaccaagcaugucgcucggauccuggaccagcgcuucaacagccaaaaggacgaggaggggaagacgauccgggccgugcgcgugguaacccucaaguccagccugaccucccaguuccggaagcaguucgccauccacaaggugcgcgagaucaacgacuaccaccacgggcacgacgccuaccugaauggcguugucgccaacagccuacugcggguuuacccccaguugcagccggaguucgucuacggggacuacccgaaauucaacgcuuauaaagccaauaaggcuaccgccaagaagcagcucuauacgaacaucaugaaguucuucgcggaagacgccgucaucaucgacgagaacggagagauucugugggacaagaagaacaucgccaccgugaagaaggugauguccuacccgcagaugaauaucgucaaaaagcccgagauccagaccgggagcuuuagcaaggagaccaucaaaccgaagggcgacucugacaaguuaaucagccgaaagacgaacugguccccaaagcucuacggcggguucgacagcccccagguggccuacuccgugauaaucaccuacgagaagggcaagaaaaagguaagggccaaggcgaucguuggaauaaccaucauggagcagagccuguucaagaaggacccgguaucccugcucgaggagaagggcuacgcaaaccccgagguccugauccaccuccccaaguacacgcuguacgagcuggagaacgggcgccggcgucuucuagcuucugccaacgaggcccagaaaggcaaccagcuggugcugcccgcguccuuagugacgcugcuuuaccacgccaagcaagucgacgaggacagcggcaaguccgaggaguacguucgcgagcaccgggcagaguucgcugagauccucaacuacguccaggccuuuucugagaccaagauccuggcgaacaagaaccuucagacgauccucaagcuguaugaggagaacaaggaggccgacaucaaggagaucgccgaguccuuugucaaccugaugaaauuuagcgccuacggggccccgauggacuucaaguucuucggcaagaccaucccccgcucccgguacacgagcgugggggagcucuuauccgccacgaucaucaaccagaguaucaccggccuguacgagacccgccguaagcucgucgacuga

SEQ ID NO: 7602 - RNA, 4005 nt, Artificial Sequence
  Cas9 variant
augcgcaagcccuacaccaucggccuggacauagggaccaacagcgugggaugggccgugcucacggaccaauacaaccuggucaagcggaagaugaagguggccgggucugccgagaagaagcagaucaagaagaacuucuggggcguccgccuguucgaugagggugagguggccgccggccggaggaugaaccguacgacccgcagacgcaucgaacggcgccggaaccggaucgccuaccuccaggagaucuucgccgcagagauggccgagguggacgccaacuucuuuuaucggcuggaggacagcuucuacaucgaguccgagaagcgccacucacggcacccauucuucgcgaccaucgaagaggagguagcguaccaugaggaauacaagacgaucuaccaccuccgcgagaaacuggugaacuccagcgacaaggccgaccugcggcucguguaccucgcccuggcccauaucaucaaguaccgcggcaacuuccucaucgaggggaugcucgacaccaagaacaccucagucgacgaggucuucaagcaauucauccagaccuauaaucagaucuucgcaagcgacaucgaggagggcucccugacgcggcuggaggagaacaaggaaguggcggaaauccucagcgagaaacuuacgcgccgggagaagcuggacaagauccucaaacuguacaccggggagaaaagcaccggcauguuugcucgcuucaucaacuugaucaucgguucgaagggcgacuucaagaaggucuucgaccucgaugagaaggccgagaucgaaugcgccaaggacacguacgaggaggaccucgaggcccugcucgcgaagaucggcgacgaauacgccgagaucuucguggccgccaagucuaccuacaaugccgugguccugagcaacaucauuaccgugacugacaccgagaccaaggcgaagcuguccgccuccaugaucgaacgcuucgacaaacacgccaaagaccucaagcggcugaaggccuucuucaagaugcagcuaccagagaaguuuaaugagguguucaacgacaucgagaaggacggcuacgccggcuacaucgacggaaagaccacccaggagaaguucuacaaguacaugaagaaaaugcucgcgaacauugacggcgccgacuacuucaucgaccagaucgaggaggagaacuuccugcguaagcaaagaacguucgacaacggcaccaucccccaccaacugcaccuagaggagcuggaggcaauccugcaccagcaggccaaguacuacccguuccuacgcaaggacuaugagaagauccggucccuggucaccuuccgcaucccguacuuuaucgggccccuggcuaacggccagagcgacuucgccuggcucacccggaaggccgacggggaaauccgccccuggaacaucgaggagaagguggacuucggcaagucggccauugacuucaucgagaagaugacgaacaaggacaccuaccugcccaaggagaauguucugccgaagcacagccuuugcuaccagaaguacauggucuacaacgagcugaccaagauccgguacaucgacgaccaggggaagacacaccacuucagcggccaggagaaacagcagauauucaacggucuuuucaagcagcagcgcaaggugaagaagaaggaccucgagcgguuccuguacacgaucaaccacaucgagucccccaccaucgagggaguggaggacgccuucaacagcuccuucgcgacuuaccacgaccugcagaagggcggggucacgcaggagauacucgacaacccccugaacgccgauaugcuggaggagaucgugaagauccugacggucuucgaggacaagcgcaugaucaaggaacagcuccagagcuucuccgacgugcuggacggcacgauauugaagaaacuggagcggcgccacuacaccggguggggccgguugagcgccaagcuacucaccggcauccgcgacaagcauucgcaccugaccauccuggauuaccugaugaacgacgacgggcugaaccggaaccugaugcaacucaucaacgacagcaaccuguccuucaagagcaucaucgagaaagagcaggucuccacagccgacaagggcauccaaagcauuguggccgaacuagcggggucgccggccaucaagaagggcauccuccagucacugaagaucguggacgagcugguagggaucaugggauaucccccgcagacgaucgucguggaaauggcccgcgaaaaccaaacgaccggcaaggggaagaacaacuccaaaccccgguucaucagccucgagaaagccaucaaggaguucgggagccagaucuugaaagaacaccccacugacaaccagugccugaagaacgaucgccuauaccuguacuaccugcagaacgggaaggacauguacaccggcaaggaacucgacauccacaaucugagcaacuacgacauagaccacauuaucccgcaguccuucaucaccgacaacagcaucgauaaccgcgugcuggugagcuccaccgcgaaucgggagaagggcgacaacguuccccuccuggaggugguccgcaagcgaaaggcguucugggagaagcuguaccaggccaagcucaugaguaagcgcaaguucgacuaccugacaaaggccgagcgcgggggccugaccgaggcugacaaagcgaacuucauccagcggcagcucguggagacccggcagauaacgaagaauguagccaacauccuguaccagcgcuucaacugcaagcaggacgagaacgggaacgaggucgagcagguucggaucgugacacugaaauccacccucgugagccaguuccguaaacaguuccagcuguacaaggugcgggaggugaacgacuaccaccacgcccacgaugccuaccugaacggcgucguggccaacacccuccugaagguguacccccagcucgagcccgaguucguuuacggggacuaccaucaguuugacugguucaaagcaaacaaggcuaccgcgaagaaacaguucuauacgaacaucaugcgcuucuucgccaaggagaaccagaucaucgacaagaacggcgagauccucugggacaaccgguaccuggacacgaucaagaaagugcuguccuaccgccagaugaacaucgugaagaaaaccgaaauccagaagggcgaguucagcaacgccaccgucaacccgaaggggaacuccagcaagcucaucucacggaaagcugauuggaaccccaucaaguacggcggguucgacggcuccaacauggccuacaguaucgugaucgaguacgagaagagaaagaagaagacggugaucaagaaggagcugauccagaucaacaucauggagcgggucgcuuuugagaaggaccaaaaagccuuccuggaggagaagggguauuacagccccaaggugcugaccaagaucccuaaguacacccuguacgagugcgaaaacggccgccggagaaugcugggcuccgccaacgaggcgcagaaggggaaucagauggugcucccgaaccaccugaugacccuccucuaccacgccaagaacugcgaggccaacgacggcgagagccuggcuuacaucgagaugcaccgggagauguucgcggagcuguuggccuacaucuccgaguuugccaagcgcuacacccuggccaacgaccgccuggagaagaucaacauguuuuucgagcaaaacaagaagggggacaucaaagucaucgccaagagcuucgacaagcucaagguguucaacgcguucggcgcgccccgggacuucgaguucuucgagaccaccaucaagcgcaagcgguacuacaacaucaaagagcuccugaacgccaccaucaucuaccagagcaucaccgggcucuaugaagcccgcaagcgucuggaggacuga

SEQ ID NO: 7603 - RNA, 4008 nt, Artificial Sequence; identical to SEQ ID NO: 1803
  Cas9 variant

SEQ ID NO: 7604 - RNA, 4011 nt, Artificial Sequence
  Cas9 variant
auggacgacaacuaccagcugaugcacgccaagggcaaguacggguacggcacccgcaucuauagcgaggggcagaccgccgcggaccggcgcggcuuccggacgacccgccggcgccucaaccggcgcaaguggcggcugcgccuguugcaggacuucuucgagcccuacauccugccgcaggacgaggccuucuucauccggcagaagcaguccaaccuggugccccaggacaccaagaagcaguaccccgagagcguccucuucgacgacaccuccgauaaagacuucuacacggaguaccccaccaucuaccaccuucgccaggcccugaugaccgagaaccggcaguucgacauccgcgagguauaccuagccauccaccacaucgugaaguaccgggggcacuuccugaacaacgccccggucaagaccuucaagagcggcaaccuggaccucgcgaucaaguucaacgagcugaacgaggaguucaaguccgucuaccccgaccuggaacuccaguucaaccuggaccagaucgacgagaucaagaagauccugcucgacaguacgaagucccguuucgaccgccagggcgaggccgugaagcugaucuacaccgucagcgaggugaagaccaucgagaagcugcagaacaagaucgugaagcaguuccucuccgggauccucggccugaacacccgcuucgacguccucacgaacaccgagagcgacgacuccauguggaaguucagccuagacuccgagagcuccgacgacgcucuggacgagaucaucgcccagcucgacgaccccgcgauccacgugguggaguuagucaacgagauccacagcuccaucacccuggccgggaucgugcccgagggccaggggcucagcgaguccaugguggagaaguaugaagcccacaaggcccaccuccagcugcugaaggcggucgagaagcugguggacaaaaaggcggccgacaagcuggagguggccuacgaccaguauaucaacggcaaggacagcaagcaguucaucaaggaggacuucuacaaggcuguccagagcgagaucaaggguguggccggggacgagguggcggagaucaaccagcucaucgagcuggaccaauucaugccgaagcagcggaccaaggagaacggcgccaucccccaccagcugcaccagcacgagcucgacgucaucaucgagaaccaauccaaguacuacgauuggcugggggagaaagugggcaacgaguacaagcuggacaagcucgugagcuuccgcguccccuacuacgugggcccccugguagacacggccucgaaggagaagaaggacgagacccgguucgccuggauggugcgcaagaacccggagucgaccgaggccauaaccccguggaacuucgaggacaucguggacaagaacgcguccgccgagaauuucaucaagcgcaugacgaccaaggacaaguaccugcucaacgaggacguccugcccaagugcagccugcucacacaggacuucgagguguacaacgagcugaacaacauccgggugaacggggaaaaguucaccgccgagcagaagcagcugauccacgacgagcuguucacgaagcacgccuccgucagcaucaagcagcucaaggacuuccugguguccgagcugauguacgugcgcgacaaccucaaggucgaaggccuggccgacgagaagaagcugaugagcucccuuagcacccaguucgacuaccagaaaaucauccccgaccaaaucaacgacgugaaguaucgggaggacaucgagcagaucaucgagugguccaccaucuucgaggacgcggccaucuucaagaccaagcugaaggagaucgacuggcugacggacgagcagcgcaacaagcucgccaacaagcgguaccgcggguggggcagccuguccaagcggcugcucgccugccugguggacgagaacgggcagcgcaucauagacauccugcgggacagcuccgacaacuucaugaugaucgucaaccgcccggaguucaagcaggcgaucuuugacgagaacgccaaccucaccgagaccaacagcaagaaggacauguucgagaugaucgacaacuucuacaccagcccccagaacaagaaggccauccgccaggugcugcuggugguccaggacauucagaacgccauggguggcguggcgccccagaaaaucuucaucgaguucgcccgggaggacgaggugaacgggcggcgcacgaacucccgguacagccagauccgcgagauguacuccaaggucaccgacgacgugaucaacaagaccguccggggugagcucgaggccaacaaggggagccugaauaaggagaagcuguuccucuacuuccugcagggcgggaucgaccuguacuccggcaagaccaucaacaucgacaacauuagcuccuacgacgucgaccacgugcucccgcagagcuucaucaaggacgacuccaucaacaacaaggugcuggucaacgccaagggcaaccgcgugaagaacgacaacgugccgauggagcuguucggggcuaagauguaccccacguggaagcggauggucgacaccggcaucaugagcaaggccaaguucaagaaccucacccugaaccccgacaacguggacaaguucaaggcggagggguucaucaaccgccagcugguggagacccgccagaucauaaagcucgucgcccagauccugaacgacaagcugggcgacgacaccaagaucguguccgugaaagccaaucucacgcacgacaugcgggucuucuucgacuuccccaagaaccgcaacgugaauaacuaccaccacgccuucgacgccuaccugagcgcguucguggggaccuaccuguacaagcgguacccgaagcuccagcccuacuucgucuacggcgaguucaagaaaauggacaagcugaagaacaugacauccuucgacuuccugcgcgaccuaaagcacaccgacaaggugguggacaaggacacgggcgagaucaucgccgacaagcuggccgucaucaccaacaugaacaagaucuacgacuucaagaaggugcuggugacgcacgagguccacgagaacagcggggccauguacgaccagacccucuaccccgcgaagcuggacaagucccugggccggaagggggccaagcagcucauccccaagaaggacgacaugccgacggcccuguacggcggcuacaccgggagcaaggacgccuucauguccaucgugcgccugaagaagaaagacgagguguacuacaaggucaucggcauccccgugcggaucgccgacagcgugcagcacgggaaggaggucgacguggaggcgcucacccaguucaucgagaccaaguucacgaaggagaaccugaacaagaagaccggcgagaucacccgcaagguggagugguucgagcugguccuccccaagguacucuucgggcaggccgucuucgacggcggccagccguucaugcugggguccagcaccuacccucacaaccuccgggagcuggugcugacgaaggacagcgugaagaagaucgccggcaaggaguccaacaagagcuaccucgacgccuacgacgagaucauggaggccaugaacaaguacuucccccuguacgacaccaacaaguuccgcgagaaggucaucgaggggcgguccaaguucaucgaucugcccgauaaggaugaguacgagaacaacaagcucguccaagugggcaagagcaccauuaucgaccgcauguucaucggucugcacgcgaacgccgcccggaccgaccugaagaacaucggcaucacuaccccguucggcuucaugcagcaggccuccgggauaaagcucaccaaggacaccguggugcuguuccagagcuccacgggccuguucgagcgcaagguggcccucaaggaccuguga

SEQ ID NO: 7605 - RNA, 4011 nt, Artificial Sequence
  Cas9 variant
augacaaaagacuacaccaucggucuggacaucgggacgaacagcgugggcugggccguccucaccgacgacuaccagcugaugaagcgcaagauguccgugcacgggaacaccgagaagaagaagauuaagaagaacuucuggggcgcccggcuguuugacgagggacagaccgcggaguuccgccggacgaagcguaccaaucggcgcagacuggcccgucggaaguaccgccuuucgaagcugcaggaccuguucgccgaggagcugugcaagcaggacgacugcuucuucgugcggcuggaggaguccuuccuaguccccgaggagaagcaguacaagccggcaagcaucuuccccacccuggaggaggagaaggaguacuaccagaaauaccccaccaucuaccaccuccgccagaagcucguugacuccacggagaaggaggaccugcggcugguguaccuagcccuggcgcaccuccugaaguaccgcggccacuuccuguucgagggcuaccuggacaccgaaaacaccaguauugaggaguccuuccgggucuuccuggaacaguaugggaagcagagcgaccagccucuuaucgugcaccagccggugcugacaauccucacggacaaguuauccaaaacuaagaaggucgaggagauccugaaguacuaccccacagagaaaaucaacucuuucuucgcccagugccucaagcugaucgugggcaaccaggccaacuucaaacgcaucuucgaucuggaggcggagguaaaacuucaguucucuaaggagaccuacgaggaggaccuggagagccugcucgagaagaucggggacgaguaccuggauaucuuccugcaggcgaagaagguccacgacgccaucuuguuguccgagaucaucagcuccacggucaagcacacgcaggccaagcugucuuccggcauggucgagcgcuacgagcgccacaaggccgaccucgccaaauucaagcaguucgucaaggagaaugugccccagaaggcgaccguguucuucaaggacaccacgaagaacggguacgccggcuacauaaagggcaagaccacccaggaggaguucuacaaguucgucaagaaggagcugagcgggguggugggcuccgagccauuccucgagaagaucgaccaggagaccuuccuccugaagcagcggacguacaccaacggggucauuccgcaccaggugcaccugauugaacucaaggccaucaucgaccagcagaaacagcacuaccccuuccuugaggaggccggccccaagaucaucgcacuguucaaguuccgaaucccuuacuacgucggcccgcucgcgaaggagcaggaagcuagcagcuucgccuggaucgagcggaagacggcggaaaagauccaccccuggaauuucuccgaagucguugacaucgaaaagagcgcaaugcgcuucauccaacgcaugaccaaacaagacacguaccugcccaccgagaagguccugcccaagaacagccugcucuaccagaaguacaugaucuuuaacgagcugaccaaggugagcuacaaggacgagcgcgggguuaagcaguacuucuccggcgacgagaagcagcagaucuucaagcagcuguuccagaaggaacgggguaagaucaccgucaagaagcuccagaacuuccuguacacgcacuaccacaucgagaacgcgcacauuuucggcaucgagaaggcuuucaacgccagcuacuccaccuaucacgacuucaugaagcuggccaagaccaaccagaaguccaugcaggaguggcucgagcaaccggaaauggaacccaucuucgaagacaucgucaagauccugacuauuuucgaggaucggcaaaugaucaagcaccagcugagcaaguaccaggagguguuuggggaaaagcugcugaaggaguucgcacgaaagcacuacacgggcuggggccgguucucagcgaagcugauccaugggauccgcgacaggaagaccaacaaaacgauccucgacuaccugaucaacgacgacgacguccccgcaaaccgcaaccggaacuuaaugcagcucauaaacgaugagcaccuguccuucaaggaggagaucgcgaaggcuaccguguucagcaagcacaagucccugguggacgucauccaggaccuccccggcuccccggcgauuaagaaggggaucuggcagucccugaagauaguggaggaacugaucgccaucaucggcuacaagccgaagaacauugugaucgagauggcccgcgagaaucagaagacccaccggacgaagccccgccucaaagcccuggagaacgggcugaagcagauuggcagcacgcuccugaaggagcagcccaccgacaacaaggccuugcagaaggagcggcucuaucuguacuaccugcagaacggcagggacauauacaccggggagccguuagacaucgagaacuuacaccaguacgaagucgaccacauaaucccucgguccuucaucguggacaacagcaucgacaacaaggucuuagucgcgucgaagcagaaccaaaagaagcgcgacgacgugcccaacaagcagaucgugaacgagcagaggaucuucuggaaccagcucaaggaggccaagcugaucagcccgaagaaauacgccuaccugacaaaaaucgagcucacccccgaggacaaggcccgcuucauacagcggcagcuggucgagacccgucagaucacgaaacacguggccaacauuuuacaccagagcuuccaccaagaggaggagggcacggacugcgacggggugcagaucaucacccucaaggcgacacugaccucccaguuccgccagacguucgguuuguacaaggucagggagaucaacccccaccaccacgcccacgacgccuaccucaacggguucaucgcuaacgugcugcugaagcgcuaccccaagcucgcccccgaguucguguacggcaaguacgucaaguacagccuggcgcgggaaaacaaggccaccgccaagaaggaguucuacuccaacauucugaaguuccucgaaucagacgagccauucugcgacgagaacggcgagaucuacugggagaaauccuaccaccucccccgcaucaagaaggugcuuucuucccaccaggugaacgucguuaagaagguggagcagcagaaggguggguucuacaaggagaccgucaauagcaaggagaagcccgacaaacugaucgagcggaagaacaacugggaugugaccaaguacgggggcuuugggucgccggugaucgccuacgccauagccuucgucuacgccaaggggaaaacgcagaaaaagacacgcgccauagagggcaucaccaucauggagcaggccgcguucgagaaggaccccaccacauucuuaaaggacaaaggguucccccaggugaccgaguucauaaagcugcccaaauacacccucuucgaguucgacaacggccggcgccgguuccuggccagccacaaggagucccagaagggcaacccguucauccugagcgaccaacucgugacccuguuguaucacgcccaacacuacgacaagauuacauaucaggaguccuucgacuacgucaacacccaccucagcgacuucuccgccauccugacagaggugcuggccuucgcggagaaguacacccucgccgacaagaacauugagcgcauucaggagcuguacgaggaaaacaaguacggcgagaucagcaugaucgcccaguccuuccugcaacuccugcaguucaacgccauaggcgcccccgcggacuucaaauucuucggaguuacuaucccccggaagagauacaccagccugaccgagaucugggacgccaccaucauauaccaaagcgucaccgggcucuaugagacccgaauccgcaugggggaccugugggccggcgagcaguga

SEQ ID NO: 7606 - RNA, 4011 nt, Artificial Sequence
  Cas9 variant
augaccaaggacuacaccaucggccuggacaucgggacgaacagcgugggcugggccguacucaccgacgacuaccagcugaugaagcgcaagauguccgugcacgggaacaccgagaagaagaagaucaagaagaacuucuggggcgcccggcuguucgaugaggggcagaccgcggaguuccgccggacgaagcgcaccaaccggcgccggcucgccagacggaaguaccgccugagcaagcugcaggaccucuucgccgaggagcuaugcaagcaggacgacugcuucuucgugcggcuggaggagaguuucuuagucccggaggagaagcaguacaagccggccagcaucuuccccacccuggaggaggagaaggaguacuaccagaaauaucccaccaucuaccaccuccgccagaagcugguggacuccacggagaaggaggaccugcggcugguguaccucgcacuggcgcaccuccugaaauaccgcggucacuuccuguucgagggcgaccuggacaccgagaacaccagcaucgaggaguccuuccgggucuuccucgagcaguacagcaagcaguccgaccagccccugaucguacaccagccggugcugaccauccuaacggacaagcugagcaagaccaagaaagucgaggagauccugaaguauuaccccaccgagaagaucaacuccuucuucgcccagugccucaagcugaucguggggaaccaggccaacuucaagcgcaucuucgaccuggaggccgaggugaagcuccaguucagcaaggagaccuacgaggaggaccuggagagccugcucgaaaagaucggcgacgaguaccuggacaucuuccugcaggcgaagaagguccacgacgccauccuccugagcgagaucaucuccagcacggugaagcacaccaaagccaagcuguccagcggcaugguggagcgguacgagcgccacaaggccgaccucgccaaguucaagcaguucgucaaggagaacgugccccagaaggcgaccguguucuucaaggacaccacgaagaacggcuacgccggguacauuaagggcaagacuacccaggaggaguucuacaaguucgucaagaaggagcuguccggcgugguggggagugagcccuuccuggagaagaucgaccaggagaccuuccuccugaagcagcggacguacacuaacggcgucaucccgcaccagguacaccugaucgagcucaaggccaucaucgaccaacagaagcagcacuaccccuuccuggaagaggccgggcccaagaucaucgcccuguucaaguuccgaauccccuacuacguuggcccgcucgcgaaggagcaggaggccagcuccuucgccuggaucgagcggaagaccgccgagaagaucaaccccuggaacuucagcgaggucguggacaucgagaaguccgccaugcgcuucauccagcgcaugaccaagcaggacacguaccugcccaccgagaagguccugcccaagaacagccugcucuaccagaaguacaugaucuucaacgagcugaccaagguguccuacaaggacgagagaggcgugaagcaguacuucagcggggacgagaagcagcagaucuucaagcagcuauuccagaaggagcgcggcaaaaucaccgucaagaagcuccagaacuuccuguacacgcacuaccacaucgagaacgcgcagaucuucgggaucgagaaggccuucaacgccuccuacagcaccuaucacgacuucaugaaacuugccaagaccaaccagaaggccaugcaggaguggcucgagcagccggagauggagcccaucuucgaggacaucgugaagauccugaccaucuucgaggaccggcaaaugaucaagcaccaacugaguaaguaccaggagguguucggcgagaagcuccugaaggaguucgcgcgcaagcacuacacgggguggggccgguucucggccaagcugauccacggcauccgcgaccggaagaccaacaagaccauccucgacuaccugaucaacgacgacgacguccccgccaaccgcaacaggaaccugaugcagcucaucaacgacgagcaccuguccuucaaggaggagaucgccaaggcgaccguguucagcaagcacaagucccugguggacgucauucaggaccuccccgggagcccggccaucaagaagggcaucuggcagucccugaagaucguggaggagcugaucgcuaucaucggguacaagcccaagaacaucgugaucgagauggcgcgugagaaccagaagacgcaccggacgagcccccgccucaaggcccuggagaacggucugaagcaaaucggguccacccuccugaaggagcagcccaccgacaacaaggcgcugcaaaaggagcggcucuaccuguacuaccugcagaacggccgcgacauguacaccggcgagccgcucgaaaucgagaaccugcaccaguaugaggucgaccacaucaucccccggagcuucaucguggacaacuccaucgacaacaaggugcuggucgccagcaagcagaaccagaagaagcgcgacgacguucccaagaagcaaaucgucaacgagcagcggaucuucuggaaccagcucaaggaggccaagcugaucagccccaagaaguacgccuaccugacgaagaucgagcucaccccggaggacaaggcccgcuucauccagcgucagcuggucgaaacccgccaaaucaccaagcacguggcgaacauccugcaccaguccuucaaccaggaggaggagggcacggauugcgacggcgugcagaucaucacgcucaaagccacccugaccagccaguuccgccagacguucgggcuguacaagguccgggagaucaacccccaccaccacgcccacgacgccuaccucaacggcuucaucgccaacguccuccugaagcgcuaccccaagcucgcgccggaguucguguacgggaaguacgucaaguacucccuggcccgggagaacaaggccaccgccaagaaggaguucuacagcaacauccugaaauuccucgaauccgacgagcccuucugcgacgagaacggcgagaucuacugggagaagucccaccaccucccucgcaucaagaaggugcugagcagccaccaggugaacgucgugaagaagguggagcagcaaaagggcggauucuacaaggagaccgucaacuccaaggagaagcccgacaagcugaucgagcggaagaacaacugggacgugaccaaguacggcggguucggcagcccggugaucgcguacgccaucgccuucgucuacgccaagggcaagacgcagaaaaagaccagagccaucgaggggaucaccaucauggagcaggcggccuucgagaaggaccccaccacguuccugaaggagaagggcuucccccaagugaccgaguucaucaagcugcccaaauacacccucuucgaguucgacaacgggcggcgccgguuccuggccucccacaaggagucgcagaagggcaauccguucauccuguccgaccagcucgugacccuccuguaccacgcccagcacuacgacaagaucacguaccaggagagcuucgacuacgucaacacccaccucuccgacuucagcgccauccugaccgaggugcuagcguucgccgagaaguacacccucgccgacaagaacaucgagcgcauccaggaacuguacgaggagaacaaguacggggagacguccaugaucgcccagagcuuccugcagcuccugcaguucaacgccauaggcgcgcccgccgacuucaaguucuucggcgugaccauuccccgcaagcgcuacaccagccugaccgagaucugggacgccacgaucaucuaccaguccgucaccgggcucuacgagacccggauccgcaugggcgaccugugggccggggagcaguga

SEQ ID NO: 7607 - RNA, 4014 nt, Artificial Sequence
  Cas9 variant
augaaaaacaugaagaagcccuacacgaucggccuggacaucgggaccaacagcgugggcugggcaguucucacggaucaguacgaccuggugaagcgcaaaaugaagaucgccggggacagugagaaaaagcagaucaagaagaacuucuggggcgugagacuguucgacgaggggcagacugcggccgaccgccggauggcaagaaccgcccggcgccggauugagcgccggagaaaccggaucucguaccuccagggcaucuuugccgaggagauguccaagaccgaugcgaacuuuuucugcaggcugagcgacuccuucuacgucgacaacgagaagaggaacagccgccauccguucuucgcaacuauugaggaggaggucgaguaccacaagaacuaucccaccaucuaccaccuccgggaggagcuggugaacuccucugagaaggcagaccuacgccuggucuacuuggccuuggcgcacauuaucaaguaucggggcaacuuccugauagagggagcguuggacacccaaaauaccuccgucgacggcaucuacaaacaguucauccagacguauaaccaaguguucgccagcgggaucgaggacggcuccuuaaagaaacuagaggacaacaaggacgucgccaagauacucguggagaaggugacgaggaaggagaagcuggagcggauccugaaacucuaccccggggagaaguccgccggcauguucgcacaguucaucagccuuaucgucggcagcaaggggaacuuccaaaagccuuucgaccugauagagaaguccgacaucgagugcgccaaggacucauacgaagaggaccuagaauccuugcuggcccucaucggcgacgaguacgcugagcuguucguggccgcgaagaacgccuacagcgccgugguccuguccagcauaaucaccguggccgagaccgagacgaacgccaagcucagcgccuccaugauagagcgcuucgacacccacgaggaggacuugggggagcugaaggccuucaucaagcuccaccucccgaagcacuacgaggaaaucuucagcaacacugagaagcacggcuacgccggcuacauagacgggaagaccaagcaggcagacuucuacaaauacaugaagaugacgcuggaaaacaucgagggcgcagacuacuuuaucgcgaagaucgagaaggagaacuuccugcggaaacagcgcaccuucgauaacggggccaucccccaccagcugcaucuggaggagcuugaggccauccugcaucagcaggccaaguacuaccccuuccugaaagagaacuacgacaaaaucaagucgcucgugaccuuccgcauccccuacuucgucggcccccuggcgaaugggcagagcgaguucgccuggcugacccgaaaggcagauggugaaauccgcccauggaacaucgaggagaagguggacuucggcaaguccgcuguggacuucaucgaaaagaugacgaacaaggacaccuaccucccaaaggagaacguccugccaaagcacagccuguguuaccagaaguaccucguguacaacgagcugacgaaggugcgguacaucaacgaucaggggaagaccuccuacuucagcggccaggagaaggagcaaaucuucaacgaccuguucaagcagaagcgcaaggucaagaagaaagaccucgaacuguuccugcggaacaugucacacguggaaagcccaacgauagaggggcuagaggacuccuucaauucuuccuacagcaccuaccacgaccuccugaaaguaggcaucaagcaggagauccuggacaaccccgugaacaccgagaugcucgagaacauagugaagauccugaccguguucgaggacaagcgcaugaucaaggagcaguuacagcaguucuccgacgugcuugacggggugguccugaagaagcuggagcggcgccauuacacgggcuggggucggcucagcgccaaacuucugauggggauccgcgacaagcagucccaccucaccauccuggacuaccugaugaacgaugacggacucaaccgcaaccucaugcagcuaaucaaugacagcaaccucuccuucaagagcaucaucgagaaggaacaggucaccacagcggacaaggacauccagucgaucguggccgaccucgccgggucccccgccaucaagaaggggauccugcagagccugaagaucguggacgagcugguguccgugaugggcuauccgccucagacgaucgucguggaaauggcucgagagaaccagaccaccggaaagggaaagaacaacagccggccccguuacaagucccuggagaaggcgaucaaggaguucgggagccagauucucaaagagcaccccacagacaaccaggagcugcggaauaaucgccuguaccucuacuaccugcagaauggcaaagacauguacacggggcaggacuuagacauccacaaccucuccaacuacgacaucgaccacaucgugccccagagcuucaucaccgacaacuccaucgacaaccucguccugaccagcuccgccggcaaccgugagaagggcgacgacgucccgccccucgagaucgugcgcaagcggaaggucuucugggaaaagcuguaccaggggaaccugaugagcaagcgcaaguucgacuaccucaccaaggccgaacgcggcgggcugaccgaggccgauaaggcccgguucauccaccgccagcugguggagacgagacagaucaccaagaacguggcgaacauccuccaccagcgcuucaacuacgagaaggacgaccacgguaacaccaugaaacaggugcggaucgugacccugaaguccgccuuggugagccaguuccgcaagcaauuccagcucuauaagguccgggacgugaaugacuaccaccacgcccacgacgccuaccugaacggcguggucgcuaacacgcugcucaagguguacccccagcuggagccagaguucguguacggcgacuaccaccaguuugacugguucaaggccaacaaggccaccgcaaagaagcaguucuacacgaacaucaugcuguucuuugcccagaaggaccgaaucaucgacgaaaacggcgagauccucugggacaagaaguaccuggacacugucaagaaggugauguccuaccggcagaugaacauagugaagaagacggagauucagaagggggaguucagcaaggcgaccaucaagccgaagggcaacuccagcaagcugaucagccgcaagacuaacugggaucccaugaaguacgggggcuuagacucccccaacauggcuuaugccgucgugaucgaauacgccaaggggaagaacaagcugguguucgagaagaagaucauccgggucaccaucauggagcgcaaggcauucgagaaggacgagaaggcguuccuggaggagcagggcuaccggcagcccaaggugcuagccaagcugccgaaguacacccuguacgagugcgaggagggccgccggcgcaugcuugccagcgcaaacgaggcccagaaggggaaucagcaaguccugcccaaccaccucgugacccuccugcaccacguggcgaauugcgagguguccgauggcaagagccuggacuacauagaguccaaccgggagauguucgccgagcucuuagcucacgucagcgaguucgcaaagcgcuacacccuggcagaggccaacuuaaacaagaucaaccaguuauuugagcagaacaaggagggggacaucaaggccaucgcccagucguuugucgacuugauggccuucaacgcgaugggcgccccagccagcuucaaauuuuucgaaacaacgauagagcgaaagcgcuacaacaaccucaaggagcugcugaacuccacaaucaucuaccagagcaucaccgggcucuacgagucucggaagcgucuggacgacuga

SEQ ID NO: 7608 - RNA, 4014 nt, Artificial Sequence; identical to SEQ ID NO: 1808
  Cas9 variant

SEQ ID NO: 7609 - RNA, 4014 nt, Artificial Sequence
  Cas9 variant
augaagaaggacuacgugaucgguuuagacaucgggaccaacagcgucggcugggccgugaugaccgaggacuaccagcucgugaagaagaagaugcccaucuacgggaacacggagaagaagaagaucaagaagaacuucuggggcguucgccuguucgaggaggggcacaccgccgaggaucggcgccugaagcggaccgcgcgccggcgcaucagccggcgccggaaccgacuacgguaccugcaggccuucuucgaggaggccaugacggaccuggacgagaacuucuucgcccgauuacaggagagcuuccuggugccggaggacaagaaguggcaccggcaccccauauucgccaagcuggaggacgagguugcguaccacgagacguaccccaccaucuaccaccuccgcaagaagcuggccgacuccagcgagcaagccgaccugcggcucauauaccuggcgcuggcgcacaucgucaaguaccgcggccacuucuuaaucgagggcaagcuguccaccgagaauaucagcgugaaggagcaguuucagcaguucaugaucaucuacaaccagaccuucgucaacggggagucccggcuggucucagcgccccuccccgagucggugcugaucgaggaagaacugacggagaaagccagccgcaccaagaaguccgagaaggugcuccaacaguucccccaggagaaggccaacggccuguucgggcaguuccugaagcucauggucggaaacaaggccgacuucaagaagguguucggccuggaggaggaggccaaaaucaccuacgccuccgaguccuacgaggaggaccuggagggcauccucgccaaggugggcgacgaguacagcgacgucuuccuggcagccaagaacguguacgacgcgguggagcuguccaccauccucgccgacagcgacaagaagucccacgccaagcugagcuccagcaugaucguucguuucacggagcaccaggaagaccugaagaaguucaagcgcuuuauucgcgagaacugccccgacgaguacgacaaccucuucaagaacgagcagaaggacggguaugccggcuauaucgcccacgcggggaaggugagccagcugaaguucuaccaguaugugaagaagaucauccaggacaucgccggcgccgaguacuuccuggagaagauugcccaggagaacuuccuucgcaagcagagaaccuucgacaacggcgucaucccccaccagauccaccuggccgagcugcaggcgauaauccaccggcaggccgccuacuaucccuuucucaaggagaaccaggagaagaucgagcagcuggugaccuuucgcauccccuacuacguggggccccuguccaagggcgacgccagcaccuucgcguggcucaagcggcaguccgaggagcccauucgcccguggaaccugcaggagacggucgaccuggaccagagcgccacagccuucaucgagcguaugaccaacuuugauaccuaccuccccagugagaaagugcugcccaagcacucucugcucuacgagaaguucauggucuucaacgagcugaccaagaucuccuacaccgacgaccgcgggaucaaggccaauuucucaggcaaggaaaaggagaagaucuucgacuaccuguucaagacccggcgcaaggucaaaaagaaagacaucauucaguuuuaucggaacgaauacaacaccgagaucgugacacuguccgggcucgaggaggaccaguucaacgccagcuucagcaccuaccaggaccugcugaagugcggcuuaacccgagccgagcuggaccaccccgacaacgccgagaaguuagaggacauaaucaagauccuuaccaucuucgaagaccggcagcgcauccggacacagcugaguaccuucaagggccaguucuccgccgagguccugaagaaacucgagcgcaagcacuacaccggauggggccggcugagcaagaagcucauaaacgggaucuacgauaaggaguccggcaaaaccauccucggguaccugaucaaggacgacggcgugagcaagcacuacaaccgcaacuucaugcagcugaucaacgacucccagcucagcuucaagaacgccauucagaaggcccaguccagcgagcacgaggagacgcugagcgagaccgugaacgagcuggcgggcuccccggccaucaagaaggggaucuaccagagccucaagaucgucgacgagcugguggccaucaugggcuacgcuccgaagcggaucguggucgagauggcccgcgagaaccagaccaccuccacggggaagcggcgcagcauccagagacugaagaucguggagaaggcgauggcagaaaucggcuccaaccuccugaaggagcagcccaccaccaacgagcagcugcgggacacccgccucuuccuguacuacaugcagaacgggaaagacauguacaccggcgacgagcugagccuccaccggcugucccacuaugacauagaccacaucaucccgcagagcuucaugaaggacgacucccuggacaaucucgugcuggucggcagcacggagaaccgcgggaaguccgacgacgugccgucuaaggagguggucaaggacaugaaggccuauugggagaaacuguacgcugcgggacucaucucccaaagaaaguuccagagacugacgaagggggagcagggcggccugacccucgaggacaaggcccacuucauccagcgacaacugguggagaccaggcagaucacgaagaacguggccgggauccuggaccagcgguacaacgcuaauagcaaggagaagaagguccagaucaucacucucaaggccucucugaccagccaguucagguccaucuucggccuguacaaggugcgugagguaaacgacuaccaccacgggcaagacgcguaccucaacugcgucguggcgaccacgcugcugaagguuuaccccaaccucgccccggaguucgucuacggcgaguaccccaaguuccagaccuucaaggagaauaaggccaccgccaaggcgaucaucuacaccaaccugcugcguuucuucacggaggacgaaccgcgguucaccaaggacggugagauccucuggagcaacagcuaccugaagaccauaaagaaggagcugaacuaccaccagaugaauaucgugaagaagguagagguccagaagggcggcuucuccaaggagagcaucaagcccaaggggcccuccaacaagcucauccccgugaagaacggccucgacccgcagaaguacgggggcuucgacagccccauaguggccuacaccguccuguuuacgcacgagaaagggaagaagccccucaucaagcaggagauccugggcaucaccaucauggagaagacccgcuucgagcagaauccgaucuuguuccuagaggagaagggcuuccugcggccccgcguacugaugaagcuccccaaguacacccuguacgaguucccggaggggcggcgcagacugcucgccuccgccaaggaggcccagaagggcaaccaaauggugcugccggagcaccuccugacgcugcuguaccacgcgaagcagugucucuuaccgaaccagagcgagucccugaccuaugucgagcagcaccagcccgaguuccaggagauacucgagcgcguuguggacuucgcagagguacacacccuggccaagagcaaggugcagcagaucgugaagcuguucgaggccaaccaaaccgcggacgucaaggagaucgcugccuccuucauucagcucaugcaauuuaacgccaugggggcgccgagcacguucaaguucuuccagaaggacaucgagcgggcgcgguacaccuccaucaaggagaucuucgacgccaccaucaucuaccagagcaccacgggccuguacgagacccgucggaaggugguggacuga

SEQ ID NO: 7610 - RNA, 4014 nt, Artificial Sequence
  Cas9 variant
augaaaaaggacuacgugaucggccuggauauagggaccaauagcgucggcugggcggugaugaccgaggacuaucagcucgugaagaaaaagaugcccaucuacgggaacaccgagaagaagaaaaucaagaagaauuucuggggcguccgacuguucgaggagggccacacagcggaggaccggcgccugaagagaaccgcgcgccggcgcaucucccggcgccgaaaccgcuugcgguaucugcaggcguuuuucgaggaggcuaugacugaccuggacgagaacuucuucgcccgccuccaggagucuuuucuggucccggaggacaagaaguggcaccggcaccccaucuuugccaagcuggaggacgaggucgcguaccacgagacguaccccaccaucuaccaccuccgcaaaaagcuggccgacucuagcgaacaggccgaccuucggcucauuuacuuagcgcuggcgcacaucgucaaauaccgcggccacuucuuaaucgagggcaaacugucuaccgagaacaccagcgugaaggaucaguuucagcaguucaugguaaucuacaaucagacguucgugaacggggaaucccgacugguuagcgcaccccucccggaguccgugcugaucgaggaggaauuaaccgaaaaggccagccggaccaagaaauccgagaagguucuucagcaguucccccaggagaaggccaacggacuguucgggcaguuccugaaguuaauggugggcaacaaggcugacuucaagaaaguuuucgggcuggaggaggaggccaagaucaccuaugccuccgaguccuacgaggaagaccucgaaggcauacucgccaagguaggcgaugaguacucggacguguuccuagccgccaaaaacguguacgaugcagucgaacuguccacgauccucgccgacucugauaagaagagucacgccaagcugagcucgucaaugauuguccgguucaccgagcaccaggaggacuuaaagaaguucaaacgcuucauccgggagaacugccccgacgaguacgacaaccucuucaagaacgagcagaaagacggauacgccggcuacaucgcccacgcggggaagguaucccagcugaaauucuaccaguaugucaaaaagaucauccaggacauugccggcgccgaguacuuccuggagaagaucgcccaagagaauuuccuccgcaagcaacgcacuuucgacaauggggugaucccccaccagauccaccuagccgaacuccaggcgaucauccaucgccaggccgccuacuauccguuccuaaaagagaaucaggagaaaaucgagcagcuugugacuuuccgcauccccuacuacgucgggccccuguccaagggcgacgccaguacauucgccugguuaaaacggcaguccgaggaacccauccgcccguggaaccugcaggagaccguugaccuggaccaguccgccaccgcauucaucgagcggaugaccaacuucgacacguacuuacccuccgagaagguccugcccaagcacagccugcucuacgagaaguucaugguuuucaaugaguugaccaagaucuccuacacagacgaccgcgggaucaaggccaacuucagcggcaaggagaaggagaagaucuucgauuaccuguuuaagacgcggcgcaaggugaagaagaaggacaucauccaauucuaucggaacgaauacaacaccgagaucgucacccuuucagggcuggaggaggaccaguucaacgccagcuucuccaccuaccaggacuuacugaaguguggccucaccagagcggagcuagaccaccccgauaacgccgagaagcuggaggauaucaucaagauccuaacgauuuucgaagaucggcagagaauccgcacccagcugagcaccuuuaagggucaguuuucagccgaggugcugaaaaagcucgaacgcaagcacuacacaggguggggucggcugagcaagaagcugaucaacgggaucuacgacaaggagucugggaagacgauccucgauuaccugaucaaagacgauggugugagcaagcacuacaacaggaacuucaugcagcugauaaacgacucccaacucuccuucaagaacgccauccaaaaggcccagaguugugagcacgaggagacccuaagcgagaccgucaacgagcuggcuggcagcccggccaucaagaaggguaucuaccagucccucaagauaguggaugagcugguggccauaaugggauacgcccccaagcggaucgucguggagauggcccgcgaaaaucagaccacgagcaccggcaagcggcgcucuauacagcgccugaagaucguggaaaaggcgauggccgaaauugggucuaaccuccugaaggagcagcccaccaccaacgagcaacugcgggacacccggcucuuucuguacuacaugcagaacggcaaggacauguacacuggggacgagcugagccuccaccggcugagccacuacgacaucgaucacaucaucccccagagcuucaugaaagacgacagccuggacaaccucguccuggugggcuccacagagaaucgcgggaagagugacgacgugccauccaagaaggucgugaaggacaugaaggccuacugggagaagcucuacgcugcgggguugaucagccagcggaaguuccagcggcugaccaagggcgaacagggcggucugacccuugaggacaaggcgcacuucauccagcggcagcugguggagacucgccagauuaccaaaaacguagcaggcauccuugaucagcgguacaacgccaaguccaaggaaaagaaggugcaaaucaucacccucaaagccagccugaccucccaguuccgcagcaucuuugggcuguacaagguccgggaggucaacgacuaccaccauggccaagaugcuuaccucaacugcgucguggccacgacccucuuaaaagucuaucccaaccucgcccccgaguucguguauggggaguaccccaaauuccaggccuucaaggagaacaaggccaccgcgaagaccauaaucuacacaaaccuaaugcgcuucuuuacagaggacgagccgcgguuuaccaaggacuccgagauccucuggagcaacuccuaccucaagacaaucaagaaggagcuaaacuaccaccagaugaacaucguaaagaaggucgaggugcagaagggcggguucuccaaggagagcaucaagcccaagggccccuccaacaagcuaaucccaguaaagaacggccucgacccgcagaaauacggcggguucgacagcccggugguggccuacacggugcuguucacacacgagaaggggaagaagccccugaucaagcaggagauccucgggaucaccaucauggagaagaccagauucgaacaaaacccgauauuguuccuggaagaaaagggguuccuccggccccgcguccugaugaaacuucccaaguacacgcucuacgaguuccccgagggccgccgccggcugcuggccuccgccaaggaggcccaaaagggcaaccagauggugcucccggagcaucugcugacccugcuguaucacgcaaagcagugccugcuccccaaucagucagagucccuggccuacguggagcagcaccagcccgaguuccaggagauacucgagcgcgucguggacuucgccgagguucacacuuuggccaaguccaaagugcagcagauugugaagcuguucgaagcgaaccaaacugccgacguuaaagagaucgccgccuccuucauccagcugaugcaauucaacgccaugggggcgcccagcacauucaaguucuuccaaaaggauaucgagcgggcucgcuacacauccaucaaggagaucuucgaugccacaaucaucuaccagaguaccacggggcucuacgagacucgccggaaagucguugacuga

SEQ ID NO: 7611 - RNA, 4014 nt, Artificial Sequence
  Cas9 variant
augaagaaagacuacgucaucggccuggauaucggcaccaauucaguaggcugggcagugaugaccgaagacuaccagcucguaaagaagaagaugcccaucuacggcaacacggagaaaaagaaaaucaagaagaacuuuuggggcguucgccuguucgaggagggacacaccgccgaggaucggcggcugaaacgcaccgcacgucggcgcaucucacgucgccgcaaccgccugcgguaucugcaggcauucuucgaggaggccaugaccgcccuggaugagaacuucuucgcgcgccuccaggagagcuuccuggugccggaggauaagaaguggcaccggcaccccaucuucgcgaaacuggaggacgagguagccuaccacgagacguaccccaccaucuaccacuuacgcaagaagcuggccgauucuagcgagcaggccgaucugcggcugaucuaucuggcgcuggcccacaucgugaaguaccgcggucacuucuuaaucgaaggaaaacucuccaccgaaaauauaagcguaaaggaacaguuccagcaguucaugaucauauacaaccagacauucguaaacggagagucccggcugguaucugcuccccucccagaguccgugcugaucgaagaggagcugacggagaaagccagccgcaccaagaaauccgagaagguccuccagcaguucccccaggaaaaggccaacggccuguucgggcaguucuuaaaacucauggucggcaacaaggccgacuucaagaaaguauucggccuggaggaggaggcuaagaucacuuaugccagcgagaguuacgaagaagaccuggaggguauccucgccaaagucggagacgaguauagcgacgucuuccuggcugcgaaaaacguguacgacgcagucgagcuguccaccauucuagccgacagcgacaagaaaucccaugccaagcugucauccagcaugaucguccgguucacagagcaccaggaggaucugaaaaauuuuaagcgguucauacgggagaacugccccgaugaguacgacaaccucuucaagaacgaacaaaaggacggguacgccggauacaucacgcacgcagggaagguuagccagcugaaguuuuaccaauacgugaagaagaucauccaggacaucgcaggcgccgaauauuuccuggaaaagaucgcucaggaaaacuucuugcgcaagcagcgcaccuucgacaacggcguaaucccccaccagauccaucuggcugagcuucaggcaaucauacaccggcaggccgccuacuacccauuccugaaggaaaaccaggagaagauagagcaacuggugaccuuccgcauccccuauuauguggggccccuuucuaaaggcgacgcaaacacauuugcguggcucaagcggcagagcgaagaacccauccgcccguggaaccugcaggagacagucgaccuggaucagucugcuacggccuucauugagagaaugaccaacuucgacacguaccuccccagcgagaagguucugcccaagcacucccugcucuacgagaaguucaugguuuuuaacgaacugacuaagauaagcuacaccgacgaccgcgggaucaaggcuaacuucucaggcaaggaaaaggagaaaaucuucgacuaccuguucaaaacccggcggaaggugaagaaaaaggacaucauacaguuuuaccgaaaugaguacaauacggagaucgucacccugagcgggcucgaggaggaucaguucaacgccagcuucuccaccuaccaggaccugcugaagugcggccucacccgcgcggagcuggaccaccccgacaacgccgagaagcuggaggacauaaucaagauccucaccauuuucgaggaccggcaaaggauucggacucaguuauccaccuucaagggccaguucagcgccgaaguccugaagaaacucgagagaaaacacuacacaggguggggccgucugagcaagaagcugaucaacgggaucuacgacaaggagagcggcaagacgauucucgauuaccugauuaaggaugaugggguuuccaagcacuacaaccgcaacuucaugcagcugaucaacgacagccaacucuccuucaaaaacgccauccagaaggcgcagagcuccgagcacgaggaaaccuugucggagaccgucaacgagcuggcgggaagcccugccaucaagaagggcaucuaccagucccucaagauuguggacgagcugguggcaaucaugggguacgccccgaagcggauagugguagaaauggcgcgagaaaaccagaccacgaguaccggcaaacggcgcuccauccagcggcucaagauaguggagaaggcuauggccgagaucggcucaaaccuccugaaggagcagcccaccaccaacgagcaacugcgggacacacgccuuuuccucuacuauaugcagaacggcaaggacauguacacgggcgacgaacugucccuacacagacuuagccacuacgacaucgaccacaucaucccgcaguccuuuaugaaggacgacagccuggacaaccucgugcuggucggcagcaccgagaaucgcggcaagagcgacgaugucccgagcaaggagguggucaaggacaugaaggcuuacugggagaaacuguacgcagcgggucuuaucagccagcgaaaguuccagcgacugaccaaaggcgagcagggcggucugacgcucgaggacaaggcccacuuuauccagcggcagcugguggagacgaggcagauuaccaagaacguggccggcauccuggaccagcgguacaacgcaaaguccaaggagaagaaggugcagaucaucaccuugaaggccucccugacaucccaguuucgcagcaucuucggguuguacaaggugcgggaggucaacgauuaccaccauggucaagacgcauaccucaacugcgucguagcuacgaccuugcuaaaaguguaucccaaucucgcccccgaguucguauacggggaauacccgaaguuccagaccuucaaggagaacaaggccaccgccaaggcgauaaucuauacuaaccugcugagguucuucaccgaggacgagccgcgguucaccaaggauggugagauccugugguccaacagcuaucugaagacuauuaagaaggaguugaacuaccaccagaugaacaucgugaaaaaggucgagguccaaaaaggcgguuuuagcaaggaguccauaaaaccaaagggcccgagcaacaagcucaucccugugaagaacgggcuggauccgcaaaaguacggcggguucgacucccccaucguggcuuauacgguccuguucacucacgaaaagggcaagaagccucucaucaagcaagagauccuuggcaucaccaucauggagaagacacgcuuugagcagaauccuauccuuuuccucgaggagaagggcuucuuacggccccgcgugcugaugaagcuccccaaauauacccuguaccaguuuccggagggccggcgucgccugcuugccagcgccaaggaggcgcagaaggggaaccagaugguacugccagaacaccuacuuacccugcuguaccaugcgaagcagugccuccugcccaaccagagcgagagccuggccuacguugagcagcaucagcccgaguuccaggaaauccucgaacgcguaguggacuucgcggagguccacacccuggcgaaguccaaagugcagcagaucgugaagcuguucgaggcgaaccagaccgcugacgucaaggagaucgccgccaguuucauucagcucaugcaauucaacgccaugggcgcgcccuccacguucaaauucuuucaaaaagacaucgagcgggcacgcuauaccaguaucaaggagaucuucgacgccaccaucauauaccaguccaccaccgggcuguacgagacccgccggaaaguuguggauuga

SEQ ID NO: 7612 - RNA, 4014 nt, Artificial Sequence
  Cas9 variant
augaagaaggacuacgugaucggccuggacauugggaccaacucagucgguugggccgugaugaccgaggacuaccaacucgugaaaaagaagaugcccaucuacgggaacacggagaagaagaaaaucaagaagaacuucuggggcguccgacuguucgaggaggggcacaccgccgaggaccggcgccugaagcgaaccgcgcgccggcgcaucucccgccgccggaaucgccuccgauaccugcaggccuuuuucgaggaggccaugaccgaccuggacgagaacuucuucgcccgccuccaggagagcuuccuggugcccgaagauaaaaaguggcaccggcaccccauuuucgccaagcuggaggacgagguagcguaccacgagacuuaccccaccaucuaccaucucagaaagaagcuggccgacuccucggagcaggccgaccugcggcucauuuaccuggcccuggcgcacaucgucaaguaccgcggccacuuccucauagagggcaagcuguccaccgagaacauaagcgugaaagagcaguuccagcaguucaugaucaucuacaaccagacauucgugaacggggagucccgccuagucagcgcaccccuaccggaguccgucuuaaucgaggaggagcugacggaaaaggccucgcgcaccaagaaguccgagaaggugcuccagcaguucccccaggagaaggccaacggccuguucgggcaguuccugaagcucauggucgguaacaaggccgacuucaagaagguguucgggcuggaggaggaggccaagaucaccuacgccagcgaaucguacgaggaggaccuggagggcaucuuagccaaagugggugacgaauauagcgacgucuuccuggccgccaagaacguuuacgacgccguggagcuguccaccauccucgccgacuccgacaagaagucccacgccaagcugagcuccuccaugaucguccgguuuacggagcaccaggaggaccugaagaaguucaagcgcuucauccgggagaacugccccgacgaguaugacaacuuauucaagaacgagcaaaaggacggguacgccggauauaucgcccacgcggggaaggugagccagcugaaguucuaccaguaugugaaaaagaucauccaggacaucgccggcgccgaauacuuccuggaaaagaucgcacaggagaacuuccuccgcaagcagcgcaccuucgacaacggcguuaucccccaccagauccaccuggccgagcugcaggcgauaauccaccggcaggccgccuacuacccguuccucaaggaaaaccaggagaaaaucgagcaguuagucaccuuccgcauccccuacuauguggggccauuaucaaaaggcgacgccagcaccuucgcuuggcuaaagcggcaguccgaggagccgauucgcccauggaaccugcaggagacggucgaccuggaccagagcgccaccgcauucauagaacggaugaccaacuucgacaccuaccuccccuccgaaaaggugcugccgaagcacagccugcucuacgagaaguucauggucuucaaugagcugacgaagaucuccuacaccgacgaccgcgguaucaaggccaacuucagcggcaaagagaaggagaaaaucuucgacuaccuguucaagacccggcgcaaggugaagaagaaggacaucauccaguucuaccggaacgaguacaacaccgagaucgugacccuguccgggcucgaggaggaccaauucaacgccagcuucucuaccuaccaggaccugcugaagugcggccugacccgcgcggagcuggaccaccccgacaacgccgagaagcuggaggauaucaucaagauccucaccaucuucgaggaccggcagcgcauccgcacucagcugaguaccuuuaagggccaguucuccgccgaggugcugaagaagcucgagcgcaagcacuacaccggguggggccggcugagcaagaaacugaucaacgggaucuacgacaaggaguccggcaagaccauucucggguaccugaucaaggacgacggcgugagcaagcacuacaaccgcaacuucaugcagcugaucaacgacucccaacucagcuucaagaacgcaauucagaaggcccaguccagcgagcacgaggagacgcugagcgagaccgugaaugagcuggcgggcuccccggccaucaagaaggggaucuaccagagucucaagaucgucgacgagcugguggccaucaugggcuacgcccccaagaggaucguggucgagauggcccgcgagaaccagaccaccaguacagggaagcggcguagcauccagcgacugaagaucguggagaaagcgauggccgaaaucggcuccaaccuccuaaaggagcagcccaccaccaacgagcagcugcgggacacccgccucuuccuguacuacaugcagaacgggaaggacauguacaccggcgacgagcuuagccuccaccggcugucccacuacgacaucgaccacaucauuccccagagcuuuaugaaggacgacucccuggacaaccucgugcuggucggcagcacggagaaccgcgggaaguccgacgacgugccuagcaaggaaguggucaaggacaugaaggccuacugggagaagcuguacgccgcgggacucaucucccagcggaaguuccagcgcuuaaccaagggagagcagggcggccugacguuagaggacaaggcccacuucauccaacgccagcugguggagacccgccagauuacgaagaacguggccgggauccuggaccagcgguacaacgccaacagcaaggagaagaagguccagaucaucacccucaaggccucccuuaccagccaguuccgcuccaucuucggccuguacaagguacgggaggugaacgacuaccaucacggacaggacgcguaccucaacugugucguggccaccacgcugcugaaggucuaccccaaccucgcccccgaguucgucuacggcgaguaccccaaauuccaaaccuucaaggagaacaaggcgaccgccaaggcgaucaucuacaccaaccuguugagguucuucacggaggacgagccgcgguucaccaaggacggggagauucucuggagcaacagcuaucugaagaccaucaagaaggagcugaacuaccaccagaugaacaucgugaagaaaguggagguacagaagggcggcuucuccaaggagagcaucaaacccaagggucccuccaacaagcucaucccagugaagaacggccuggacccgcagaaauacggggguuucgacagccccaucguggccuacaccguccuguucacucacgagaagggcaagaagccccucaucaagcaggagauccugggcaucaccaucauggagaagacccgcuucgagcagaacccaauccuguuccucgaggagaagggauuccugcggccccgcgugcuuaugaaacuccccaaguacacccuguacgaguuccccgagggacggcgccggcugcucgccuccgccaaggaggcacagaagggcaaccagaugguguuaccggagcaccuccugacgcugcuguaccacgcgaagcagugccuccugcccaaccagagcgagucccuggccuacgucgagcagcaccagcccgaguuucaggagauccucgagcgcgugguggacuucgccgagguacacacccuggcaaagagcaaggugcagcaaaucgugaaacuguucgaggcgaaccagaccgccgacgucaaggagaucgccgccuccuucauccagcucaugcaguucaacgccaugggggcgcccagcaccuucaaguuuuuccagaaggauaucgagcgggcccgcuacacgucuauaaaggagaucuuugacgccaccaucauuuaccagagcaccaccggccuguacgagacgcgccggaaggugguggacuga

SEQ ID NO: 7613 - RNA, 4017 nt, Artificial Sequence; identical to SEQ ID NO: 1813
  Cas9 variant

SEQ ID NO: 7614 - RNA, 4017 nt, Artificial Sequence
  Cas9 variant
augaagcaggaguacuuccugggccucgacauggggaccggcagucuggggugggccguaaccgacuccaccuaccaggucaugcguaaacacggcaaagcccugugggggacccggcuguucgagagcgcgucuaccgccgaggagcgccggauguuucguaccgcccggcgccggcuggauaggcggaacuggcgcauccaggugcugcaggagauauucagcgaggagaucuccaagguggaccccggguucuuccuccggaugaaggagagcaaguacuacccggaggacaagcgcgacgccgagggcaacugcccagagcugcccuacgcccuguucgucgacgacaacuacacggauaagaacuaccacaaggacuaucccaccaucuaccaccuccggaagaugcugauggagaccaccgaaaucccggacauccgccugguguaucucgugcugcaccacaugaugaagcaccgggggcacuuccugcucuccggcgacaucagccagaucaaggaguucaaguccacguucgagcagcugauccagaauauccaggacgaggagcuggaguggcacaucagccucgacgacgcggccauccaguucgucgaacacgugcugaaggaccgcaaccugacccgguccaccaagaagucccgccucaucaaacagcugaacgccaagagcgccugcgagaaagcgauccugaaccuccuuagcgggggcaccgugaagcuguccgacaucuucaacaacaaggagcucgacgagagcgagcggcccaaggucuccuucgccgacagcggcuacgacgacuacaucggcaucguggaggccgagcuggccgagcaguacuacaucaucgccuccgcgaaggccguguacgacuggagcguccugguggagauccucggcaacagcgugucgaucagcgaggcgaagaucaaggucuaccagaagcaccaagccgaccugaagacgcugaagaagauagugcgccaguauaugaccaaggaggacuacaagcggguguucgucgacaccgaggagaagcuaaacaacuacuccgcguacaucgggaugaccaagaagaacggcaagaagguggaccucaagagcaagcagugcacgcaggcggacuucuacgacuuccugaagaaaaacgugaucaaggucaucgaccacaaggagaucacccaggagaucgaguccgagaucgagaaggagaacuuccuccccaagcaggucaccaaggacaacggggugauccccuaccaggugcaugacuacgagcugaagaagauacuggacaaccucggcacccgcaugccguucaucaaggaaaaugccgagaagauccagcagcuguucgaguuccgcauccccuacuacgugggcccccugaaccgggucgacgacgggaaggacggcaaguucacguggagcgugcgcaaguccgacgcccggaucuaucccuggaacuucaccgaggugaucgacguagaggccagcgccgagaaguucauccgccggaugaccaacaagugcaccuaccucgugggggaggacgugcugccgaaggacagucuggucuacagcaaguucauggugcucaacgagcugaacaaccugcgccucaacggcgaaaagaucuccguggagcugaagcagcggaucuacgaggaacuguucugcaaguaccgcaaggucacgaggaagaagcuggagcgcuaccucgugaucgaggggaucgcgaagaagggcguggagaucaccggcaucgacggggacuucaaggccagccucaccgccuaccacgacuucaaggagcggcugaccgacguccagcucucccagcgcgccaaggaggccaucgugcugaacgugguccuguucggcgacgacaagaagcuccugaagcagcggcugagcaaaauguaccccaaccucacgaccgggcagcugaagggcaucugcucccugagcuaccagggguggggccgccucuccaagaccuuccuggaggagaucaccgugcccgcacccggcacgggggagguguggaacauuaugaccgcccuguggcagaccaacgacaaccucaugcagcugcugagccggaacuacggcuucaccaacgaggucgaggaguucaauacacucaagaaggagaccgaccuguccuacaagaccguggacgagcuguacgugagcccggccgucaagcgccagaucuggcagacccucaagguggugaaggagauccagaaggucauggggaacgcccccaagcggguguucguggagauggcgcgcgagaagcaggagggcaagcggagcgacucccgcaagaagcagcuggucgagcuguaccgcgccugcaagaacgaggagcgggacuggaucaccgagcucaacgcccagagcgaccagcaauugcgcuccgacaagcuguuccucuacuacauccagaaggggcggugcauguacagcggcgagacgauccagcuggacgagcugugggacaacaccaaguacgacaucgaccacaucuacccccaguccaagaccauggacgacagccucaacaaccgcgugcuggugaagaaaaacuacaacgccaucaaguccgacaccuacccccugagccucgauauccagaaaaagaugauguccuucuggaagaugcugcagcagcaggguuucaucacgaaggagaaguacguccggcuggugcgcagcgacgagcucucagccgacgagcuggcgggguucaucgagcggcagaucguggagacccgccaaagcaccaaggccgucgccaccauccugaaagaggcccucccggacacggagaucguguacguaaaggccggcaacgucuccaacuuccggcagaccuacgagcugcugaaggugcgcgagaugaacgaucuccaccacgcgaaggacgccuacuugaauaucguggucgggaacgccuacuucgugaaguucaccaagaacgccgccugguucauccggaacaaccccggacgcagcuacaaccugaagcggauguucgaguucgacaucgagcgcucaggcgagaucgcguggaaggccgggaacaagggcagcaucgugaccgucaagaaggugaugcagaagaacaacauccucgugacgcgaaaggccuacgaggucaagggcgggcuguucgaccagcagaucaugaagaaggggaagggccaggugcccaucaagggcaacgacgagcgccuggccgacaucgagaaguacgggggcuauaacaaggcggccgggaccuacuuuaugcucgugaagucccuggacaagaaggggaaggagauccggaccaucgaguucgucccccuguaccucaagaaccagaucgagaucaaccacgagagcgccauccaguaccuugcccaggagcgcgggcugaacagcccugaaauccuccuguccaagaucaagaucgacacccuguucaagguggacggcuucaagauguggcucagcggccggacggggaaccagcugaucuucaagggcgccaaccagcugauccucucccaccaggaggcggccauccugaaggggguggucaaguacgugaaccgcaagaacgagaauaaggacgccaagcugagcgagcgggacggcaugaccgaggagaagcuccugcagcuguacgacaccuuccuugacaagcuguccaacaccgucuacuccauccgccuguccgcccagaucaagacgcucaccgagaagcgcgccaaguucauugggcugagcaacgaggaccagugcaucgugcugaacgagauccuccacauguuccagugccaguccggcagcgcgaaccugaagcugaucggcgggcccggcuccgccgggauccucgugaugaacaacaacaucacagccugcaagcagaucagcgucaucaaccagucccccaccgggaucuacgagaaggagaucgaccugaucaagcuguga

SEQ ID NO: 7615 - RNA, 4017 nt, Artificial Sequence; identical to SEQ ID NO: 1815
  Cas9 variant

SEQ ID NO: 7616 - RNA, 4017 nt, Artificial Sequence
  Cas9 variant
augcgggacuacuacaucggccucgaccuagggacgggcagccucgggugggcagucacagacagggaauacgaaauaaugcgcgcacauggcaaagcccuauggggggugcgacuauucgacuccgcuaacacagcggaagaaagacgaggauuccgaacagcucgucgacgccucgaccggagaaacuggcgaaucgaacuacugcaagaacuauucggagaggauauuggaaaagucgacuccggguucuuccuccgcaugaaagaaagcaaguacaugcccgaagacaaacgggacgugaauggcaacugccccaagcuacccuacgcacucuucgucgaagacggcuacacggacaaagacuaccacagacaguucccaacuaucuaccaccuccgaaaguggcuaauggaaaccgaggaaacaccagauauacgccucgucuaccuugcucuacaucacaugaugaaacaccgaggacacuuucucuucagcggcaacauagagaaaauuaaagaguuucaagaaaccuuccgccaauauauaggcaaaauacgggaggaagagcucgacuuccaccugugcauagaaggagaagaacucagggaaaccgagaacauacugaaggacaagaaccucacgagaucagcaaaaaaaacucgccuaauaaagcugcucggggcccacacggccugcgaaaaagcagcccuuaaccuggucgcggggggaaccgucaaacucagcgacaucuucggaaacagcgaacuggacgccugcgagaagccaaaacucuccuucgccgacgcuggauacgacgacuaugccggcaugauugaggacgaacucggagagcaacacguaauaauagaaacggccaaggcugucuacgacuggagcgugcucgccgacauacuaggagacuaccggugcauaagcgaagcaaaagcagccguauacgagaaacaucagaaagaccugcgacaccuaaaagagcuggugaaggaaaaccucggacgcgacguauacaaggaaguguuugugaaaaccaacgagaaauugccaaacuacagugccuacauaggaaugaccaagaaaaacggagucaaaagcgagauggagggaaagcgaugcgaccgcaaggccuucuacgacuacuuaaagaagacagucguaaacgcgauaccagacgaaucaaagaccgaauaucucagaaaggagauggaaacggaaacguuccugccgagacaaguaacaaaagacaacgggguaauaccucaccaagugcaccuccaagaacuugacgcaauccuagaaaaccucagcggaagaaucccagcgcuaaaagaaaacggaucaaaaauccgcgacauuuucacauucagaauaccguacuacguaggcccacuuaacggcauagucaaaggaggcgaacgcacgaacuggguaagaagaaagaaagcaggccgaauaugcccuuggaacuucgacgagaugguugacacgggcgcaucggcagaagaauucauacgaaggaugaccucaaaguguacauacuugauccacgaggacgugcuacccaaaaacagcaugcucuacucaaaauucaugguccuaaacgaacugaacaacguccgccucaauggcgaaccaauauccgucgaacuaaagcagaaaacauacgaggaccucuuucagcgccaucgaaaagucacccgccgccgacugaccgacuauauccgacgagaaggcauagcaggccgugacgccgacaucacgggcaucgacggcgacuucaaggguagucugaccgccuaccacgacuucaaggagaaauuaacagggugcgagcugagccaagccgacaaagagaacauaauccuaaacaucacucuauucggggaagacaaggcacuacuaaaaaagaggcucggcgcccuauauccagcgcuaacagaaccccaaaaaaaagcuaucugcgcgcuuagcuacaaaggcuggggcagacucagccaaagacuacuggagggaaucacggcccccgcaccagaaacgggcgagauauggaccgugauucgggccaugugggaaacaaacgacaaucuaaugcaggugcuauccgagaaauacugcuucgccgcagcgaucgacgaagagaacgccggcgaggagcucaaagagauaaccuacaaaacaguggaacaaaugaacgucaguccggccguccggcgacaaauauggcagagccuacaaguaaucaaagaaauauguaaagucaugggcggacccccgaaacgaguuuucgucgaaauggcaagggaaaaaauggaaagcaaaagaaccgaaucacguaaaaaaaggcuaauagaccuguacaaaaagugccgcgaagaagaaagggacuggaucgaagaacucgggaauaccgaagaaacacgacucagaucagacaagcuauaccucuauuacacccaaaaaggacggugcauguauagcggcgaggucaucgagcuggaagaacuaugggacaaccggaaauacgacaucgaccacauauauccacaaagcaaagucauggacgacagucuagauaaucgcgugcucgucaaaaaggaguacaacgcagacaaaacggacgaauaccccauacgugcagacauacggggaaaaaugcgcgccuucuggcggauacuaagggaggaaggcuucaucuccaaagagaaguacaaccgccugacccgaggaacaggcuucgagccaagcgagcucgcaggcuucaucgcacggcaguugguugagacgcgacaaggaacaaaggcggucgcgucggugcuaaaacaagucuucccggaaaccgacauagucuacgcgaaagcacgcgucgccagccaguuuaggcaagaauucgaccuuaucaagguacgagaaaugaaugacuuacaccacgccaaggaugcauacguaaauaucgucgucggcaaugucuacuacaccaaauucaccucgaacgcagcgugguacgucaaagagcacccagggcgauccuacaaccuaaagaaaauguucacgagugaacgagauguagcaagaaacggagaaacugcauggcgugcaggaaacucgggaacaaucgccaccgucaaacgcgucaugggcaagaacaauauacuggugacccgccgcuccuacgagguuaagggcggacuauuugaccaacaacuaaugaagaaagguaagggccagguaccuaucaaaggcagagaugaaagacuggccgauaucgauaaguauggaggauacaauaaggcggcaggcacguacuucaugcucgccgaaagcgaagacaaaaaaggagccaaaauccgcucgguggaauacguaccgcuauaccucugcaacugcauagagaaggacgaagaggcggcaaaaaaauaccuccagaaagaacgaggacucaaaaaccccaggguucuaaucgcgaaaauaaaaaucgacacgcuuuuuaaaguggacggguucuacauguggcuaagcggaaggacaggaaaccaacuaaucuucaagggcgccaaccaacuaauacucagcgagccagacaugagaauacuuaagaagguccucaaguauguaaaucggaaaaaggaaaacaaaaaugccguacugggugaacacgaucagcuaccggaaacagacuuaauccgauuauacgacgucuuucuagacaaaauagaaaacaccguauaccacguaagacucucagcccaacaaggaacucuaacaaaaaacaaagacaccuucugcgaacugucaaaugaggacaaaugcaucguccucucagaaauucuccacauguuccaaugccaguccggaucggccaaccuaaaacucaucaaaggaccaggcagcgcaggcauacuagugcugaacaacauaaucucgaagugcaaccaggucaguaucauccaccaaucacccacagggauauacgaacaggaaaucgaccucaaaaaaauauga

SEQ ID NO: 7617 - RNA, 4020 nt, Artificial Sequence
  Cas9 variant
augaacaaggccuauacccugggccuugacaucgggacaaacagcgugggcugggccgucguuacggacgacuaccgacugauggcgaagaaaaugcccgugcacuccaagauggaaaagaagaagaucaagaagaacuucuggggcgcacggcuguucgacgaggggcagaccgcagaggagcgccggaacaagcgcgccacccggcgccggcuccgccggagaaaguaccggauccuggagcugcagaagaucuucagcgaggagauccucaagaaggacucccacuucuucgcccgacuggaugagagcuuccugaucccggaggacaagcaguacgcuagguuucccaucuuccccacgcuccuggaggagaaggccuacuaccagaacuaccccacgaucuaccaccuucgccaaaagcuggcagacuccaccgagaaggccgacauccgguuagucuaccuggcgcucgcgcacaugaucaaguaccgugggcacuuccuguucgaaggcgagcuggacaccgagaacaccagcguggaggagacguucaaggaguuuaucgacauauacaacgagcaguucgaggagggcaucaucuucuacaaagacaucccgcucauccugaccgauaaacuguccaaaagcaaaaagguggagaagaucuuacaguacuaccccaaggagaagaccaccgguugccuggcccaguuccugaaguuaauagucggcaaccaggggaacuucaagcaggccuuccaccuggacgaggaggugaagauccagaucucgaaggagacguacgaggaggaucuggagaaacuccugcgcaagagcaacgaagagaugaucgacguguuccuccaggugaagaaaguguacgacgccauccugcuguccgacauccugagcaccaagaugaaggacaccaaggcgaaacucuccgccggcaugaucgagcgguaccagaaccacaagaaggaccuggaggagcugaagcaguucgugcgggcccaccuccacgagaaggucaccguguucuucaaggacucauccaaggacggguacgccggcuacaucgacggcaagacgacccaggccgacuucuacaaguuccuaaagaaggagcugaccggggugccgggcagcgagcccaugcuugcgaaaauagaccaggagaacuuccugcugaagcagcggaccccgacgaacggggucaucccccaccaagugcacuugaccgaguucaaagccaucaucgaccagcagaagcaauacuaccccuuccuggagaaguccaaggagaagaugauccagcugcucaccuuccggauccccuacuacgugggaccgcuggcccaggacaaggagaccagcuccuucgccuggcuggagcgcaagacgaccgagaagaucaagcccuggaacgccaaggacgucaucgacuacggcgcgagcgccaccaaguucauccagcgcaugaucaacuacgacaccuacuuacccacggagaaggugcugcccaaguauagcaugcuguaccagaaguacaccaucuuuaacgagcugaccaagguggccuacaaggacgaccgggggaucaagcaccaguucuccagcgaggaaaagcuccgcaucuuccaggagcuguucaaaaagcaacggcgcguaaccaagaagaagcugcagcacuuccucuccgccaacuacaacaucgaggacgccgagauccugggcguggacaagguguucaacagcuccuacgcgacguaccacgacuuccuggaacucgccaagccguacaccgagaaaaucaucgagcugcuggagcagccugagauggaggagauguucgaggacaucgucaagaucaucaccaucuucgaggaccgggagauggugcgcacccaacuaaagaaguaccagcggauucugggggaggagaucuucaagaagcuggucaagaagaaguacacaggcuggggucgacucucuaagcggcugaucaacggcauccgcgaccagaagaccaacaagacuauccuggacuaccucaucaacgacgacgacuuucccuauaaccggaaccgcaacuucaugcagcugaucaacgacgaccaccuguccuucaaggaggagaucgccaaggagcucacccugagcgacaagcagucccugcucgaggugguggaggccauccccggcagcccggcgaucaagaagggcaucuggcagacucugaaaaucgucgaggaguugauugccaucaucggcuacaagcccaagaauaucgugaucgaaauggcccgggaaaaccagacgaccaccggggguaagaaccguuccaaaccccggcucaagucucuggaggaggcccugaagaacuucgacucccagcuccugaaggaacgccccguggacaaccagagccugcagaaggaccggcucuaccuauacuaccugcagaacgggaaggacauguacacuggcgagucccucgacaucgaccgccugagcgaguacgacaucgaccacaucaucccgcgguccuucaucgucgaccacucucuggacaacaaggugcucguguccagcaaggagaaccggcugaagaaagacgacguccccgacagcaagguggugaagcgcaugaaggccuacugggagaagcugcuccgggcgaaccugauauccgagcgcaaauucagcuaccugacgaaauuggagcugaccgacgacgacaaggcccgguucauccaacgccagcuggucgagacccgacagaucacuaagcacguggccgcaaucuugcaccaguacuucaaccaaacccaggagcuggagaaggagaaggacauccgcaucaucacacugaaguccucccucgugucccaauuccggcaggucuucggcauccacaaggugcgcgagaucaaccaccaccaccacgcccacgacgcauaccugaacgccgugguagcccuagcacuccugaagaaguacccccgguuggcccccgaguucguguauggcagcuucgccaaguuccaccucguaaaggagaacaaggccaccgcaaagaaggaguucuacuccaacauacugaaguucuuugagaaggaggagcaguucugcgacgagaacggagagaucuucugggacaagcgcaagcacauccagcagaucaagaaggucaucuccucccaccaagugaacaucgugaagaaggucgaggugcaaaccgggagcuucuauaaggagacggugaacaccaaggaaaagccggauaagcugaucaagcggaagaacaacugggacgucacaaaguacggcggguucggcuccccggugguggccuacgcggucguguucaccuacgaaaagggcaagaaccacaagaaggccaaggccaucgaggggaucacgaucauggagcaggcccucuucgagaaggaccccauuucuuuccugaucgagaagggcuacuccaacgugaaccaguucaucaagcugccgaaguacacccucuucgagcuggccaacgggcagcgccggaugcuggcgagccaccaggagcuccagaaggccaacuccuucauccugcccgagaagcucgucacccuccuguaccacgccaaccacuacgacgagaucgccuacaaggacagcuacgacuacguuaacgagcacuucuccaacuuccaggacauccuggacaaggugaucaucuuugcugagaaguacacgagcgcgccccagaagcucaaccagaucaucgccaccuacgagaagaaccaggaggccgaccgcaaaaucauggcccacagcuucgucaaccugaugcaguucaacgcccugggcgcgcccgccgacuucaaguucuucgacaccaccaucacccggaagcgcuacacgucccuuaccgagaucuggcagagcaccauaaucuaccaguccgugaccggccuauacgagacgcggcgccggauggccgaccugugggacggggugcaguga

SEQ ID NO: 7618 - RNA, 4020 nt, Artificial Sequence; identical to SEQ ID NO: 1818
  Cas9 variant

SEQ ID NO: 7619 - RNA, 4020 nt, Artificial Sequence
  Cas9 variant
augagccugaacacgaacaagaaguacaacaucggccucgacaucgggaccacguccgugggcugggcagucaccgacgccgacgggcagaaguugcugaaggccaagaacaagaaccucuggggcgugucgcuguuugaggccgggaagaccgcggccgagcgccggggcuaccgcuccacucggcgccggcugaaccaccgcaaguuccggcuccgcuuacuggaggacauguucgagaaggagauccucagcaaggaccccuccuucuucauccggcugaaggaggccuuucuuagccccaaggacgaacagaagcaguucaagggcaacauccucuucaacgacaaggacuacacugacgcggacuacuacgagcaguacaaaaccaucuaucaccuccgcuacgaucugaucucccagcaccgacaauucgacauccgcgagguguaccucgccauccaccaccugaucaaguaccgggggcacuucauauacgaggaccagaccuucaccacggauggcaaccagcugcagcaccacaucaaggccauuaucaccaugaucaauagcauccucaaccgcaucaucauccccgagaccaucgacauuaacgucuuugagaagacccuguuggaccggacgaugaaucgcuccagcaaggugaaguuccucaucgagcugaccggggaggacaagcaggacaagccccugcucaaggagcuguuuaaccugaucgugggccucaaggcgaagcccgcguccaucuucgagcaggagaaccuggccaccauagucgagaccaugaacaugagcaccgagcagguccaacuggaccuccugacccuggccgacgugcucgccgacgaggaguacgaucuccugcucaccgcccagaagaucuacuccgcgauuauccuggacgagagcauggacggguacgaguacuucgccgaggccaaaaaggaguccuaccggaagcaccaggaggaguuggugcucgugaagaagaugcucaagucaaacgccaucaccaacgacgagcgcgccaaguucgaguacuuuuacaccgacuacaucggcgcgaaguccagcaacuacgaggaguccaagaucaucaagaagggccugucagcugccuacgggaaguacagcaaggaggaacggcuguucaagcacaucgagcugcugcucgccaaggagaacgugcugaccacuguugagcaugaccugcucgagaagaacaucaccuucgccucccugcugccguugcagcgcagcucccggaacgcgguuauccccuaccaggugcacgaaaaggagcucgucgccauccuggagaaccaggccaccuauuaccccuuccugcucgagcagaaggacaacauacacaagcuguuaaccuuccgcauccccuacuacgugggcccucucgccgaccagaaggacagcgaguucgccuggauggugcgcaaacaggcugggaagauaacccccuucaacuucgaggagauggucgacaucgacgccuccagcgaggcguucaucaagcggaugacaaacaagugcacguaccugauccacgaggacguaauccccaagcacuccuucagcuacgccaaguucgagguccucaacgagcucaacaaaauccgccuggacggcaagcccaucgacauaccgcugaagaagaggaucuucgaaggccucuucuuagagaaaaccaaggucacccacacaagucugaagaaguggcucgcggaauaugagcacaugacggugagcgugguccaggggacccagaaagagacggaguucgccaccucccugcaggccuuccaucgcuucgugaagaucuucgaccgggagacggucagcaaccccgccaacgaggagauguucgagaagaucaucuacugguccaccguguuugaggacaaaaagaucaugcgccggaaacuuagcgaguauccccagcucaccgagcagcagcagguccagcuggcccaggugcgcuuccggggcuggggucgccugucccagcgguugaucaaccgcaucaagacccccgugagcggcgacgaggaccacaagcuguccaucaacgagauccuguggcagaccaacgagaacuucaugcagaucaucaggaacaaggacuaccucuucaagaagaucaucgaggagcaguucgagaacgagacggcgcuguugaacaagcagcgcaucgacgagcucgccaccagcccggccaacaagaaggggauuuggcaggccaucaagaucgugaaggagcuggagaagguccugcagcagcccgccgagaacaucuucaucgaguucgcgcgguccgacgaggaaagcaagcgcagcacgccccgggacaaguucaucgagaaggccuacgcccagcucaagaaggagaccgacacguucaaccuggagcaucugaaggagcucaagcagcgcuccaagcagcugagcucgcagcggcuguuccucuacuucauccaaaacgguaagugcauguacagcggcgagcaccuggacauagagcgccuggauuccuacgagguggaccacauccucccccagagcuacaucaaggacaacuccaucgagaaccuggcccuggugaaaaaggucgagaaccaaagaaagaaggacagccucuuacugaacuccagcaucaucaaccagaacuacucucggugggagcaacucaagaacgccgggcuaaucggcgagaagaaguuucgcaaccucacccggaccaagauaaccgaccgcgacaaggagggguucaucgcgcggcagcucguggagacgcgucagaucaccaagcacgugacucaacugcugcagcaggaguacaaggacaccacaaaggucuucgccaucaaggcaacccucgugagcgaccugcggcgcaaguucgaguucaucaagaaccggaacgugaacgauuaccaccacgcccaggacgcguuccuggucgcguuccucggcacaaacaucaccuccaacuacccgaagauagagauggaguaccuguucaagggguaccagcacuaucugaacgaggugggcaagagcgccgccaaacccaaauucacguucaucguggagaaucucuccaagcagcaguacaacuccaccacaggcgaggucaaguggaaccccgagguggacauagccaagcugaagcgcauccugaacuucaagcagugcaacaucgugcggaaggucgaggagcaguccggggcgcuguucaaggagaccaucuaccccguggaggaaagcagcuccaagacaaucccgcugaagaagcaccuggacaccgcuaucuacggcggguacaccgccguuaacuacgccagcuacgcccucauccaguuuaagaagggccguaagcugaagcgggagaucaucggaaucccucuggcgguccagacccgcaucgacaacuccgagacgagcuugcagaccuauaucgccgagcagaucaaguccgagguggaaauacugaacggucggauucugaaguaccagcugauuagcaacaacggaaaccgacuauauaucgccgggccccgcgagcgccacaacgcccggcagcugauaguguccgacgaagccgcgaaggucaucuggcucaucagcaccaagcaggccgucgaggccaccuuccugaaacacuacacgcuggagcaccuggaggccguguucgaggaguugauccgcaagcaggcggccgacuaccagaucuucgagaauuuaaucaagaagaucgagguuaacaaggccuacuucuacuccugcaccuacaaugagaaggucaaggugaucgaggagcuccugaagaucacccaggccaacgccaccaacggcgaccucaagcuccugaagaugacgaaccgggaggggcggcugggcagugucuccguggcgcucgacuucaaaauaaucaaccagagcgugaccggccuguaccaguccaucgaggacuacaacaacuga

SEQ ID NO: 7620 - RNA, 4020 nt, Artificial Sequence; identical to SEQ ID NO: 1820
  Cas9 variant

SEQ ID NO: 7621 - RNA, 4020 nt, Artificial Sequence
  Cas9 variant
augaagaaggaguacaccaucggccuggauaucgggaccaauagcguaggcugguccgucuugacggacgacuaccgccuggugagcaagaagaugaagguggccgggaacacugagaaguccagcaccaagaagaacuucuggggcguccggcuguucgacgaggggcagaccgccgaggcgcgccgguccaagcgcacggcccggcgccggcucgcccgccggcgccagcggauccuggagcugcagaagaucuuugcccccgagauccucaagaucgacgagcacuucuucgcccgccugaacgagagcuuccugguacucgacgagaagaagcagucccgucacccgguguucgcgaccaucaagcaggaaaaguccuaccaccagaccuaccccaccaucuaccaccuccgccaggcacuggccgacagcagcgagaaggccgacauccggcucgucuaccuggcgauggcccaccuccugaaguaccgaggccacuuccugaucgagggcgagcugaacaccgagaacuccuccgugaccgagaccuuccggcaguuccucuccaccuacaaccagcaguucagcgaggccgacgacaagcagacggagaagcuggacgaggccguggacugcuccuucgucuucaccgagaagaugagcaagaccaagaaggccgagacccugcucaaguacuucccccacgagaaguccaacggguaccugagccaguucaucaagcugauggugggcaaccaggggaacuucaagaacguuuucggccucgaggaggcgaagcugcaguucuccaaggagacguacgaggaggaccuggaggagcuccuggagaagaucggggacgacuacaucgaccuguucguccaggccaagaauguguacgacgccgugcuccugagcgagauccugagcgacuccaccaagaacacccgcgccaaacucagcgccggcaugauccggcgcuacgacgcccacaaggaggaccuggucuuacucaagagauucguuaaggagaaccugcccaagaaguaccgcgccuucuucggcgacaacuccgugaacggguacgccggcuacaucgaggggcacgccacccaggaggacuucuacaaguucgucaagaaggagcugacgggcauccgcggcagcgagguguuccugaccaagaucgagcaggagaacuuccugcggaagcagcgcaccuucgacaacggggugaucccgcaccagauccaccugaccgagcuccgggccaucaucgcgaaccagaagaagcacuaccccuuccugaaggaggagcaggagaagcuggagucccuccucacguucaagauccccuacuacgucggcccccuggccaagaagcaggagaacagcccguucgcguggcucauacgcaaguccgaggagaagaucaagcccuggaaccugcccgaaaucguggauauggaggggagcgccgugcgguucaucgagcgcaugaucaacaccgacauguacaugccccacaacaaaguccugccgaagaacucccugcucuaccagaaguucagcaucuacaacgagcucaccaaggugcgguaccaggacgagcgcggccagaugaacuauuucuccagcaucgagaagaaggagaucuuccacgagcuguucgagaagaaccggaaggucaccaagaaggaccuccaggaguuccuguaccugaaguacgacaucaagcacgccgagcucuccgggaucgaaaaggcguucaacgccagcuacacgaccuaccacgacuuccugaccauguccgagaacaagcgcgagaugaagcaguggcuggaggacccugagcucgccagcauguucgaggagaucaucaagacccugacgguguucgaggaccgggagaugaucaagacccgccugucccaccacgaggccacccucggcaagcacaucaucaagaagcugaccaagaagcacuauacgggcugggggcggcugagcaaggaguuaauccagggcauccgcgacaagcaauccaacaagacuauucuggacuaccugauuaacgacgacgacuucccccaccaccggaaccgcaacuucaugcagcucaucaacgacgacagccugagcuucaagaaggagaucaagaaggcgcagaugaucaccgauaccgagaaccuggaggagaucgugaaggagcucaccgggucccccgccaucaagaagggcauccugcagagccugaagaucgucgacgagaucguggggaucaugggcuacgagccggccaacaucguggucgagauggcccgggagaaccagacgaccggccgcgggcucaaguccagccggccucgccugaaggcccuggaggagucccucaaggacuucggcagccaacugcugaaggaguaccccacagacaacuccucucuccagaaggaccgccuguaccuguacuaccuccagaacgggcgggacauguacaccggcgcgccccuggacauccaccgccuguccgacuacgacaucgaccacaucaucccgcggagcuucacgaccgacaacuccaucgacaacaagguucucgugagcuccaaggagaaccggcucaagaaggacgacguccccagcgagaagguggugaagaagaugcgguccuucugguacgaccuguacuccucuaagcucaucuccaagagaaagcuggacaaccugaccaagaucaagcucaccgaggaggacaaggccggguucaucaagcggcagcuggucgagacgcgccagaucaccaagcacguggccggcauccuccaccaccgguucaacaaggccgaagacaccaacgagcccauccguaaggugcggauuaucacgcucaagagcgcccuggucucccaguuccgcaauagauucggcaucuauaaggugcgcgagaucaacgaguaccaccacgcgcacgacgccuaccugaacgggguggucgcccucgcccuguuaaagaaguacccccagcucgccccggaguucguguacggcgaguaccugaaguucaacgcgcacaaggccaacaaggccacggugaagaaggaguucuacagcaacaucaugaaguucuucgaguccgacacccccgucugcgaugagaacggggagaucuucugggacaagagcaagagcauagcccaggugaagaaggugaucaaccaccaccacaugaacaucgucaagaagaccgagauccagaagggcggcuucucaaaagagaccguggagcccaagaaggacuccagcaagcugcucccccggaagaacaacugggacccugccaaguacgguggccugggaucccccaacguggccuauacggucgccuucaccuacgagaagggcaaggcccgcaagcggaccaacgcccuggaggggaucaccaucauggagagggaggcguucgagcagagccccguccuguuccugaagaacaagggcuacgagcaggccgagauagagaugaagcugccgaaguacgcccuuuucgagcuggagaacggucggaagcgcaugguggcguccaacaaggaggcccagaaggcgaacagcuuccugcucccugagcaccuagucacgcugcucuaccacgccaagcaguacgacgagaucucccacaaggagagcuucgacuacgugaacgagcaccacaaggaguucuccgagguguucgcccggguccuggaguucgccgggaaguauacccuggccgagaagaacaucgagaaguuagagaagauuuacaaggagaaccagaccgacgaccuggcgaagcuggccagcuccuucgugaaccucaugcaguucaacgccaugggcgcccccgcggacuucaaguucuucgacgugaccauaccccguaagcgcuacacaagccugaccgagaucuggcaguccaccaucauccaccagagcaucaccgggcucuacgagacgcggauccgcaugggcaaguga

SEQ ID NO: 7622 - RNA, 4023 nt, Artificial Sequence
  Cas9 variant
augaagaaggaguauaccaucggccucgacaucgggacuaacagcgugggcuggucuguacucaccgacgacuaccgccuggugucgaagaaaaugaagguggccgggaacaccgagaaguccagcaccaagaagaacuuuuggggcguccgccuguucgacgaggggcaaaccgccgaggcgcgacgcuccaagcgcacggcccggcgccggcuugcgcgucggcgccagcggauccuggagcugcagaagaucuucgcccccgagauccuaaagaucgacgagcacuucuucgcccgccugaacgaguccuuccugguguuggacgagaagaagcagucgaggcacccgguuuuugcgaccauuaagcaggagaagucguaccaccagaccuaccccaccauuuaccaccuccgccaggcccuggccgacagcagugagaaagccgauauccgucucgucuaccuggcgauggcucaccuccugaaguaucgcggacacuuccugaucgaaggcgaacugaacacggaaaauuccagcguaaccgagaccuucagacaguuccuuuccaccuacaaccagcaguucagcgaggccgacgacaagcagacggagaagcuggaugaagccguggauugcuccuucgucuucaccgagaagaugagcaagaccaaaaaggccgagacacugcucaaguacuucccccacgagaaguccaacggguaccuaagccaguucaucaaguugauggugggcaaccaggggaacuucaagaacguuuucggccucgaggaggaagcgaagcugcaguucuccaaggagacguacgaggaggaccuggaggaacuccuggagaagaucggggacgauuacaucgaucuguucguccaggccaagaauguguacgacgcggugcuccugucggaaauucuaagcgacuccaccaagaacacgcgcgcuaagcuaucagccggcaugaucaggcgguacgacgcgcacaaggaggaccucguccugcucaagcgcuucgugaaggagaaccugcccaagaaguauagagccuucuucggcgacaacagcgucaacggguacgcgggcuauaucgaagggcacgccacccaggaggacuucuacaaguucgucaagaaggagcugacggggauccgcggcagcgaaguguucuugaccaagaucgagcaggagaacuuccugcggaagcagcgcacauucgauaacggggugaucccgcaccagauccauuuaacagagcuccgagccauuaucgcgaaccagaagaaacacuaccccuuccugaaggaggagcaggagaaguuggagucucuccugacguucaagauccccuacuacgucggcccccuggccaagaagcaggaaaauagcccguucgccuggcucauccgcaaguccgaggagaagaucaagcccuggaacuugccagagauaguggacauggaggggagcgccgugcguuucauugagcgcaugaucaacaccgacauguacaugccccauaacaaagucuuaccgaaaaacucccugcucuaccaaaaauucagcaucuacaacgaacugaccaagguucgguaccaggaugaacgcggccagaugaacuauuucuccagcaucgagaagaaggagaucuuccacgagcuguucgagaagaaccggaaagucacaaagaaggaccuccaagaauuuuuauaccugaaguacgacaucaagcaugccgagcucuccgggaucgagaaggcauucaacgccagcuacacgaccuaccacgauuuccugaccaugucugagaacaagcgcgagaugaagcaauggcuggaggaccccgaguuagccaguauguucgaggaaaucaucaagacccugacgguguucgaggaccgggagaugaucaagacccgccuuucccaccacgaggccacccucggcaagcacaucaucaagaagcugaccaaaaagcacuacacggguugggggcggcugagcaaggaacucauacaagguauccgcgacaagcaguccaauaagaccauccuggacuaccugaucaacgacgacgacuucccccaccaccgcaaucgcaacuucaugcagcucaucaacgacgacagccugagcuucaagaaagagaucaagaaggcgcagaugaucacugauaccgagaaccuggaggagaucgugaaggagcucaccgggagccccgcaaucaagaagggcauccugcagagccuaaaaaucguggacgaaauuguggggaucaugggcuacgagccggcgaacaucguggucgagauggcccgggagaaccagacaaccggccgagggcucaaguccagcaggccgagacugaaggcacuggaggagucccucaaggacuucggaucgcagcugcugaaggaguauccaaccgacaacuccagccuccaaaaggacagacuguaccuguacuaccuccaaaauggacgggacauguacaccggcgcgccacuggacauccauaggcuauccgacuacgacaucgaccacaucaucccccgcagcuucacgaccgauaacagcaucgacaacaaggugcucguaagcucaaaggagaaucgacugaaaaaggacgauguccccucagagaaaguugucaagaagaugcgguccuucugguacgaccuauacagcuccaagcucaucucgaagcgcaagcuggacaaccugacaaagauaaaacuaaccgaggaggacaaggccggauuuaucaagcggcagcugguggagacgcgccagaucaccaagcacguggccggcauccugcaccaccgguucaacaaggccgaggacaccaacgagccgauccguaaggugcggaucauaacucucaagagcgcccuggucucccaauuccgcaaccgguucggcauauacaaggugcgcgagaucaacgaauaccaccacgcgcaugacgccuacuuaaauggaguggucgcucucgcccugcugaagaaguacccccagcucgccccagaguucguguacggcgaauaucucaaauucaacgcacacaaggcaaacaaggcgacggugaagaaggaguucuacagcaacaucaugaaguucuuugaguccgacacccccgucugcgacgaaaacggggagauuuucugggacaagagcaagagcauagcccaggugaaaaaggugauuaaccaccaccacaugaacauagucaaaaagacagagauccagaagggcggcuucagcaaggagaccguggagcccaagaaggacuccagcaagcuccuccccaggaagaauaacugggacccggcgaaguacgggggacuggggucccccaauguugccuacacggucgccuucaccuacgagaagggcaaggcccguaagcggaccaacgccuuagagggcaucaccaucauggagcgcgaggcguucgagcagagccccgugcuguuccugaagaacaaaggcuacgagcaagccgaaaucgagaugaagcugcccaaguacgcccucuucgaacucgagaacgggcggaagcgaaugguggccucaaacaaggaggcccagaaggcgaacagcuuccugcucccugagcaccuggucacgcugcucuaccacgccaagcaguaugaugagauuucacacaaggaauccuucgacuacgugaacgagcaccauaaggaguucagugaggucuucgcccggguccuggaguucgcagggaaguacacccuggccgaaaagaauaucgagaagcucgagaagauauacaaggagaaccagaccgacgaccuggccaagcuagccagcuccuucgugaaucucaugcaguucaacgccaugggcgccccagcggacuucaaguucuucgacgugaccauucccagaaagagguacacgucacugaccgagaucuggcaguccaccauuauccaucagagcaucaccgggcucuaugagacucggauaagaaugggcaaguga

SEQ ID NO: 7623 - RNA, 4023 nt, Artificial Sequence
  Cas9 variant
augaaaacagacuacuuuaugggacuagacaugggaaccggcagccucggcugggccgugacagacuccagcuaccaccucugccgugcccacggcaaggaccucuggggcguaagacuguucgagaccgcacagacagccgaagaacgcagagucuucagaugcaaccgacgacgacuagaccgaagaaagagacgcauccaacugcuccaggacauauucgcaccagagaucuacaagaucgacccuggauuuuuccuccggcugaaagaaucacgcuaccuacccgaagacaagaaaaaccuagaaggcaaaaccccggaacuccccuacgcguuauucguagauaagaaauacacagauaaagacuuccacaaagaauacccaacgaucuaccaccucaggcucaggcucaugcaagaccguaccccugccgauguaagacucgucuaccuagcgcugcaucaccucauaaaacaccgcggccacuuccuguucgccggcauagaagcggacaaggucaccgacuucagcgcagcauucagcgaguuccuacgcauagugcaagagcaggaacuagacauuaguuucaccccagaugaggaaaguucucagaucauaaaagaaacccuacaaaauaccaacuucacccgguccaagaaauccacagaguuaaucaaaggccuaaaagcaagcaccgggugcgaaaaagcacuccucaagcucauaucaggauguaaaguaaaacucucagcaguauucgacgacccaggcugcgacgccuacgaaaaaccacaagucugcuuugccgagagcucauacgaggacuacgcagcaauccuugaagacgagcucgaagaucgauucaucguaauagcugccgccaaagcacuauacgacugguccguccuaguaaacauacuaggagaggcuuccacaguauccgaagccaagguaggcaucuaugaaaaacaccgcagagaccucaaauaccuaaaacaucuagucaaaaccaaucuaaccagagaagacuaccaggaccuguucgucaaggccggagcaaagaaaaacaacuacugcgccuauauaggcaugacaaagaaaaauaauaaaaaggucgugcucgaagagaaacgaugcacaaaagaagacuucuacgcauaccucaagaaagaaaucuacagcaaaguccaagaaaaucccgaggcugaguaccuucuagaggaacuagagaaagggacuuuccugccucgacaaguuuccaaggacaacggaguaauccccuaccaacuccaauuucuugaacuccaaaagauccucaaaaacgccguagaauaccuaccguuccuaaaagaggaguccgagaaaauucaacagaucaugacuuuuaggauaccauacuacgucggcccccucaacggcaagaaagaaggacaaaauacguuugcaugggcaguacgcaaaaacaacgaacccgucuauccauggaacuucgaagaagucaucgauaccgaggcauccgccgaacaauucauaagacgaaugaccaacaagugcacauaccugccaggcgaggacguacuaccaaaggaaagccuucuauauucaaaguucaugguacugaacgaacuaaacaaucugaggaucaacgggaccaaaaucuccgucgaacucaaacaagagcuguacgaaaagcuguuccaaagauaccgcaaaguguccgcaaagaaacuccgagauuaccuaguucgaaacggaauaaccgaaaaagacgccgaaaucucggggaucgacggggacuuuaaaggcacccuccgcgcauaccaugacuucaaagagaagcuaacagguguggaacugacagaagcagagaaagaaaccaucauacuaaacauaacucucuucggcgaggacaagguccuccucaagaagcgaaugcaaagacuacuacccaacuugacagaaggccagaaaaaggccaucguaacccuaaacuauucaggcugggggaggcuaucacgagaguucuuagaagaagugcaagcccccaacccggaauccggagaaauacuuucaauaauacgcgcgcugugggaaaccaacgccaaucuaaugcagcugcuguccaaccaguacggauaccaagaaauccuugagcaaaugcgagccgacuggacagggcauaaauuagacuaccagacaguggaggaacuguacguuagccccgcagucaaacgccaaaucuggcaaacacuacaagucgucaaagagcugaaaaagguaaugggaggcgaaccaaagaggguauuucuagaagucgcccgggagaagauggaguccggacgcacgguaucccgaaagaaacaccuaaaggaccucuaccuaagcugcaaaucagaggaacggaacuggcucgccgaacuagaccgacacgaggaacacucauacaggucugaccgccuuuuccuguacuacacacagaaaggccgcugcauguacugcgggaaaccgaucgacuuaggacaccugugggacgucaacauguaugacaucgaccauaucuacccccaguccaaagugauggacgacucaauucgcaaccguguacucacgugcaggaccuguaacgccgagaaaacagaccacuacccccucaaagccgaaaucagacagaaaaugcggcccuucugggacucgcucaaggcgggaaacuucauagaagaggaaaaguggaaacgacuaauucgcuccgaagaguuuaccuccaccgagcuggccggguucaucgaacgucaguuaguagaaacccgccagagcaccaaagccguggcggacauccuaaaacaagcaaugccagaaacggaaauaguuuacgugaaggccaaaaacguauccgcguucagacaagacuucaauuucgucaagaaccgagacguaaacgacuuccaccacgcgaaggacgccuaccucaacauagucgucggaaacacauacuucgucaaauucaccaagaacgccucgugguucaucgaaagaaacccaggacgauccuacaaucuaaagcgaauguucaccucagacuacgacgugaugucaaauggagagauagcuuggaaagccggcaauuccggaacaaucaccacaguacgcaaaaugaugaaaaagaacucugugcuguucacgcgacgcuccuuugagguuagcggcggcuuguucgaccagcagcuuaugaagaaaggaaaaggccagguauacgucaaaucaggggacgaacggcuccgcagcaucgaaaaguaugggggcuacaacaaagccaccggagcauacuucaugcucguggagucagaagggaaaaagggaguaaagaaacgcaccauagaguucgucccccuguaccggaaagcugaacuugaagccuccgaagagaaaaugcucgaauaccuccgcacagaaaucggccucaaggagccccacguauuacuacacaagaucaaaaccgacacgcuauuccaagcggacggguucaagaugcaccugucagggcgaaccggaaaacagcuaguguucaaaggcgcaaaccaauuccucguagcagaagacuacgaacgccuacuuaagaaagucggaaaagugaccgaacaacuaaaaacaaacaaaaacuacaaaauaaacgacuacgauggcauuacagaggaaggccucaaagcucucuacuccgaguuccuaucgaaacuacagaaggcacccuacggaaaccgucugggcacacaagcagagacgcucgaaaacggcaaggaaaaguuugacaagcucagucucgaaaacaaaugccaagugcucucagagauucuccaccucuuccaguguaacagcagcgcagcagaccuguccaaacuagguggaccaggccacgggggaauacuuguccugagcaacgagaucaccaagugcaacaagaucuccaucauacaccaauccccagccggcauauacgaacaagaaauugaccugaagacacuauga

SEQ ID NO: 7624 - RNA, 4023 nt, Artificial Sequence
  Cas9 variant
auggagcaggaguacuacuuaggccucgacauggggaccggaagcguggggugggcagucaccgacuccgaguaccacgugcugcgcaagcacggcaaggcucuguggggcgugcgccucuucgagucugcguccacugcugaggagcggcggauguuccgcacuucucggcgccggcuggacagacggaacuggcgcaucgagauccuccaggagaucuucgccgaggagaucucgaagaaggaccccggguucuuccuccggaugaaggagagcaaauacuaccccgaggacaagcgagacaucaacggcaacugccccgagcugcccuacgcccuguucgucgacgacgacuucaccgacaaggacuaccacaagaaguucccgaccauuuaccaccuccggaagauguugaugaacacggaggagaccccggacauccgccugguguaccucgccauccaccacaugaugaagcacagaggucacuuccugcuguccggcgacaucaacgagaucaaggaguucgggaccaccuucagcaagcuccuggagaacaucaagaacgaggagcuugauuggaaucucgagcugggcaaggaggaguacgcgguggucgaguccauccugaaggacaacaugcucaaccgcagcacgaagaagacacggcugaucaaggcccugaaggccaaguccaucugcgagaaggccguacucaaccugcuggccgggggcaccgugaagcucagugacaucuucggccuggaggagcugaacgagaccgagcgccccaagaucuccuucgccgacaacggguacgacgacuacaucggcgagguggagaacgagcucggggaacaguucuacauuaucgagacggccaaggccguauacgacugggccgugcuggucgagauccucggcaaguauaccucgaucucugaggcgaagguggccaccuacgagaagcacaaaagcgaccuccaguuccugaagaaaaucgugcggaaguaccugaccaaggaggaguacaaggacaucuucgucuccacgagcgacaagcucaagaacuacuccgccuacaucggcaugaccaagaucaacggaaagaaaguagaccugcagagcaagagaugcagcaaggaggaguucuacgacuucauuaagaaaaacgugcuuaagaagcucgagggccagcccgaguacgaguaccugaaagaggagcuggaacgggagaccuuccucccaaagcaggucaaccgcgacaacggggugaucccguaccagauccaccuguacgagcugaagaaaauccucggcaaccugcgcgacaagaucgaccugaucaaggagaacgaggacaaacucgugcagcuauucgaguuccggauccccuacuacgucgggccccugaacaagaucgacgacggcaaggagggcaaguucaccugggccgugcgcaaguccaacgagaagauauaccccuggaacuucgaaaacguggucgacaucgaggccagcgcggaaaaguucauccggcgcaugacgaacaagugcaccuaucugaugggggaggaugugcucccgaaggacucgcugcuguacagcaaguauaugguccucaacgaacuaaacaacgugaagcuggacggcgagaagcucuccguggagcuaaaacagcgucuguacaccgacguuuucugcaaguauaggaagguaacugugaagaagaucaagaacuaccucaagugcgaggggauaaucucugguaacgucgagaucacggggaucgacggggacuucaaggccucccugaccgcauaccacgacuucaaggaaauccugaccggcacagagcucgcuaagaaggacaaggagaacaucaucacgaacaucgugcuguucggggacgacaagaagcugcucaagaagcggcugaaccgucuguacccccagaucacccccaaccagcucaagaagaucugcgcccuaagcuacacuggcugggggcgguucuccaagaaguuucuggaggaaauaaccgcgccugacccggagacgggagagguguggaacaucaucaccgccuuaugggagagcaacaacaaccugaugcagcugcucuccaacgaauaccgcuucauggaggaagucgagaccuacaauauggggaagcaaaccaagacgcugagcuacgagaccguggaaaacauguacguaagccccagcgucaagcggcagaucuggcagacccugaagauagugaaggagcucgagaaagugaugaaggagucccccaagcgcgucuucaucgagauggcccgggagaagcaggagagcaaacgcaccgagucccggaagaagcagcugaucgaccuguacaaggccugcaagaacgaggagaaggacugggugaaggagcucggggaccaggaggagcagaagcugcgcagcgacaagcuguaccucuacuacacccagaagggccggugcauguacuccggagaggugaucgaacugaaggaccugugggacaacacgaaguacgacaucgaccacaucuacccacagagcaaaaccauggacgacagccucaacaacaggguccuggugaagaagaaguacaacgcuaccaaguccgacaaguacccgcugaacgagaacauacggcacgagcgcaagggcuucuggaaguccuugcuggaugggggauucaucagcaaggagaaguaugagcggcugauccggaacacagaacucagccccgaggaacuggcgggcuucaucgagcgccagaucguggaaacgcggcagucgaccaaagccgucgccgagauccugaagcaggucuuccccgagagcgagaucguguacgugaaggccgggaccgugucccgcuuccgcaaggacuucgagcuccugaaggugcgggaggucaaugaccugcaccacgcgaaggacgccuaccucaacaucguggugggcaacagcuacuaugucaaguucaccaagaacgccuccugguuuaucaaggaaaaccccggccggacguacaacuugaagaagauguucaccagcggcuggaacaucgaacgcaauggggagguggccugggaggugggcaagaagggcaccaucguuaccgugaagcagaucaugaacaagaacaacauccuagugacgcgccaggugcacgaggcaaagggcggccucuucgaccagcagaucaugaagaaggggaaggggcagaucgcgaucaaggagaccgacgagcggcuggcauccaucgagaaguacggggguuacaacaaggccgccggcgccuacuucaugcugguggagucuaaagacaagaaggggaagacgauccggacuaucgaguucaucccguuguaccugaagaauaagaucgaguccgacgagucgaucgcgcugaacuuccucgagaagggccgcgggcugaaagagcccaagauccugcucaagaagauuaagaucgauacgcuguucgacguggauggcuucaagauguggcucuccgggcggaccggcgaucgccuccuguucaagugugccaaccagcugauccuagacgaaaagauaaucguaaccaugaagaagaucgugaaguucauccagcggcgccaggagaaccgggagcugaaacugagcgacaaggacggcauugacaacgaggugcucauggagaucuacaacaccuuugucgacaagcuggagaacacgguguaccgcaucaggcuguccgaacaggccaagacccucaucgacaagcagaaggaguucgaacgccugucucuugaggacaaaagcuccacccucuucgagauccugcacaucuuccagugucagagcuccgcagccaacuuaaagaugaucggcgggcccgggaaggcggggauccucgugaugaacaacaacaucagcaagugcaacaagaucuccaucaucaaccaaagcccuaccgggaucuucgagaacgagaucgaccugcugaagaucuga

SEQ ID NO: 7625 - RNA, 4023 nt, Artificial Sequence
  Cas9 variant
augggugaggaguacuuuuuggggcucgacaugggcaccgggagccugggaugggccguuacggacgacaaguaccagauccugcgccggcacgggaacgcccucuggggcguccgccuguucgagacugcgaacaccgccgaggagcgucgcauguuccggaccaaccgccggcgccuggaccggcagggcuggcgcaucaagauccuccaggagcuguucgccgaggagaucugcaggguggaccccggguucuaccugcguaugaaggaaagcaaguacuacccggaggacaagcgggacgccaacggcgagugccccgcccuccccuacgcgcuguucgcagacgcccaguacaccgacaaggacuaucaccgcgaguuccccacgaucuaccaccuccggaagaugcugauggagaccgagaccacccccgacauccgccugguguaccuggccuuccaccacaugaugaagcaccgggggcauuuccuccuaagcggcgacaucucacaggucacggaguuccgcaacaccuuccugcagaugaucgcgaacaucaagagcgaggagcucgacuucucccuggagaucgaagagacccagauggggcagaucgaagccgugcugaaggaccacaagcucacccggagcgagaagaagcgccggcugacgcagauccugaagcccgccaccgccugcgagaaggccaucuuuacccuccugaguggcgggaccgugaagcucuccgacaucuucgggaaggcggagcucgaugagggcgagcgccccaagaucuccuucgccgacaacggguacgacgacuacagcgccuccgucgaggccgaccugggcgagcaguacuauaucaucgagagcgccaaggcgguguacgacugguccgugcugagcgacauccucggggacuccgucagcaucuccgacgccaaggugaagcuguacgagaagcacaagaaggaccuggccuaccuuaagaaggugguccgcgaaaaccuuccccgggaaguguacaaccagguguuugucaacacugacgagaagcugugcaacuacugcgcguacaucgggauggccaagaaaaacgggaggaagguggcgcucgaggguaaacgcugcacccgcgaggaguucgagagcuuccugcggaagaagaucgucaacaagaucgaggacaaggagauccaggaguaccuguccgaggagaucgagaagggcaccuuccucccgcgccaggucaccaaggacaacgggguuauccccuaccagauccaccuguacgagcugcggaagauaaucgacaaccucagcccccgcaugcccuucauccgggacaacggcgacaagaucauccagcuguucacguuccggauaccguacuacgugggcccccuggggaagggcgaggggagcgagaaguucuccugggccguucggcgcaccgacgaggcaaucuaccccuggaacuuuaaagacgugaucgauguggaagccagcgcugagaaauucaucugccggaugaccaacaagugcaccuacuuguacggcgaggacguccugcccaaagacucgccgcuauauagcaaguucauggugcucaacgagcugaacaaccugaagcuggacgggcaguccgucagcguggagcucaagcaacgcaucuaccaggagcuguucugccacacgcggaaggugacccagaagaagcuggucuccuaccucgugcgcgaggguaucaccggcaagaacguggagaucagcgggaucgacggagacuucaaggcgucccuaaccgccuaccacgacuucaaggagaagcugacgggggucgagcucagccagcaggagcaggaggagaucgugcggaacaucgugcuuuucggcgaggacaagaagcugcuuaagcagcgccuggaggggcgguucccccagcugacacagaagcagaucuccgucaucgccacucucagcuacaagggcuggggccgccugucccgcgaguuccuggagaacauaaccgugcccgcccccgggacgggcgagguguggaacaucaucaccgcgcucugggagaccaacgacaaccugaugcaacugcucuacggggaguacggcuuccagacggagaucgagugcuucaacgcaaaggagaagaagaagucccucagcuacgagacgaucgaggagagcuacgucuccccgagcgugaagcggcagaucuggcagacccuccaaguggucaaggagcugaagaagguuaugcgcggcgaccccaagcguguguucaucgagauggcccgcgagaaccaggaguccaagcggaccgagagccgcaagaagacccugcuugaccucuacaagaacugcaagaaggaggagcccgaguggaucgccgagcuaaccgagcaccuggagaaacuugacgacagccagcugcggaaggacaagcuguuccuuuauuacacgcagaaggggcgcugcauguacuccggcgagcggaucgaacuggaagaccugugggacaacacacgcuacgacaucgaccacaucuacccccagucaaagaccauggacgacuccgucgacaaccgggugcugguuaaaaaggaguacaacgccaagaagaccgacgucuacccgaucgcggcagacauccgcgggaagaugucgcccuucuggaagaagcugcuggacaauaaacucauaagcaagaagaaguacgaccgguuggugcgcacagaagaacugacccccgaggagcucgccggcuucaucgaccggcagcugguggagacccgccagagcacuaaggucguggccgagauccugaaggaggccuucccagacaccgagaucguuuacgucaaggcggggaauguguccaacuuccgacacauguucgacaucgugaagguccgcgagcucaacgaucugcaccacgccaaggacgccuacuugaacaucguggugggcaacgccuacuacguuaaguucaacaagaacgccgcaugguucaucaaggagaacccgggucggagcuacaaucucaaacgcauguucgacuacgacauccgccgcaacaacgagguggccuggcuggccggguccacaggcaccaucagccaggugaagaacauggucuccaagaaccacaucuuggugacccgcaagagcuacgaggugaccgggggccucuucgaccagcaacugaugaagaaggggaagggccagguucccgugaagacguccgacgagcggcugggcaacaucgagaaguacgggggauacaacaaggccuccggggcguacuucaugcucgugaaguccaaaaacaagaagggcgaggaacagcgcacaaucgaguacguccccaucuaccugaagcacuacaucgaggaaagcaaggagaacgcccucgacuaccucaagaacgagcggaagcugaacgagccggagauccugcucgauaagaucaagaaggacacccuguuccgcgugaacggguucuacaugugccugaguaagcggacgggcaagcaacuggccuucaagggggccaacgagcugcugcuccccgaacccgagacucugcugcucaagaagaucaccaaguacauacagcgccggaaggagaacaaggaccugaagcugaccaagcaggauaacaucacggagaaggagcuccuggagcuguaugacguguucaccgaaaagcucaaccacagcgucuacgccgugugccuggggacccaaggcaagacccuggugcagaagaagcccgcguucguugcccucccgguggaggagaagugcaucguguuaagcgagauccugcaccucuuucagugccaguccgggagcgccaaccuuaaacuuaucggcgggcccgccuccgcagggauccuauaccugaacagcaacauuuccgacgcgggcgagauccugaucauuaaccagagccccuccgggaucuucgaaaagcgcaucgaccuccugcgucuguga

SEQ ID NO: 7626 - RNA, 4023 nt, Artificial Sequence
  Cas9 variant
augaagaaggaauacaccaucggccuggacaucgggaccaacucggugggcugguccguccucacggacgacuaccgccuggugagcaagaagaugaaggucgccgggaacacggaaaaguccagcaccaagaagaacuucuggggcguccggcuguucgacgaggggcaaaccgccgaggcgcgccgguccaaacgcacggcccggcgcagacucgcccgccggcgccagcggauccuugagcugcagaagaucuuugcucccgagauccucaagaucgaugagcacuucuucgcccgccugaacgagagcuuccuggugccggaugagaagaagcagucccggcaccccguguucgcgaccaucaagcaggagaaguccuaccaccagacguaccccaccaucuaccaccuccgccaggcgcuggccgacagcucugagaaggccgacauccggcuggucuacuuggcgauggcucaccuccugaaguaccgcggccacuuccucauugagggcgagcugaacacggagaacuccaguguaaccgagacguuucggcaguucuuauccaccuacaaccagcaguucagcgaggccggggacaagcagacggagaagcucgacgaggccguggacugcuccuucgucuuuaccgagaagaugagcaagaccaagaaggccgagacccugcugaaguacuucccccacgaaaagagcaacggcuaucugagccaguucaucaagcugaugguggggaaccagggcaacuuuaagaacguguucgggcuggaggaggaggcgaagcuccaguucuccaaggagacguacgaagaggaucuggaggagcugcucgagaaaaucggcgacgacuacaucgacuuauucguccaggccaagaacguguaugacgccgugcugcucagcgaaauccugagcgacuccaccaagaacacccgcgccaagcugagcgccggaaugauccggagauacgacgcgcacaaggaggaccucguccugcugaagcgguucgugaaggagaaccucccgaagaaauaccgcgccuucuucggggauaauucggugaacggcuacgccggcuacaucgagggccacgccacccaggaggccuucuacaaguucgucaagaaggaguuaacgggcauccgcgggagugagguguucuuaaccaagaucgagcaggagaacuuccuccggaagcagcgcaccuuugacaacggcgugaucccucaccagauccaccuguccgagcugcgggcgaucaucgccaaccagaaaaagcacuaccccuuccugaaggaggagcaggagaagcuggagagccugcucaccuucaagauccccuacuacguggggcccuuagccaaaaagcaggaaaacucacccuucgccuggcugauccgcaaguccgaggagaagaucaagcccuggaaccuccccgagaucguggacauggaaggcuccgcagugcgguuuaucgaacgcaugaucaacacggacauguacaugccgcacaacaaaguccugcccaagaauagccugcuguaccagaaguucuccauauacaaugagcucaccaaagugcgauaccaagacgagcgggggcagaugaacuacuucaguuccaucgagaagaaggagaucuuucacgagcuguucgagaagaacagaaaggucaccaaaaaggaccuacaggaguuccucuaccugaaguacgacaucaagcacgcagagcugagcggcaucgagaaggccuucaacgccuccuacaccacguaucacgacuuccucaccaugagcgagaacaaacgcgagaugaagcaguggcuggaggaccccgagcuggccuccauguucgaggagaucauaaagacgcucaccguguucgaggaccgggagaugaucaagacgcgccugagccaccacgaggcgaccuuaggcaagcauaucaucaaaaagcucaccaagaagcacuacaccggguggggccgguuaagcaaggagcugauccaagggauccgcgauaagcagagcaacaagacgauacucgacuaccugaucaacgacgacgacuucccccaccaccggaaccgaaacuucaugcagcugaucaacgacgacagccucuccuucaagaaggaaaucaagaaggcccagaugaucaccgacaccgagaaccuggaggagaucgugaaagaacugaccggcaguccggccaucaagaaggggauccugcagucccugaagaucgucgacgagaucgugggcaucaugggcuacgagcccgccaacaucguggucgagauggcucgggagaaucagaccacggggcgcggacucaaaagcucccggccccgccugaaggcguuagaagagagccugaaggacuucgguucccagcuccugaaggaguaccccaccgacaacagcucccugcagaaggaccgccucuaccuguacuaccugcagaauggccgggacauguacaccggggccccgcucgacauccaccgcuugucugacuacgacaucgaccacauaauccccagguccuucaccacggacaacagcaucgauaacaaggugcugguguccagcaaggagaaccgccucaagaaggacgacguucccuccgaaaagguggugaaaaagaugcggagcuuuugguacgaucuguacuccagcaagcugaucuccaagagaaagcucgacaaccugaccaagaucaagcugaccgaggaggacaaggccggcuucaucaagcggcagcucgucgaaacccgccagaucacgaagcacguggccggcauucugcaccaucgguucaacaaggccgaggacaccaacgaccccauccgcaaggugcgcaucaucacccugaaguccgcucucgucagccaguuccgcaaccgguucgggaucuacaaggugcgcgagaucaacgaguaccaccacgcccacgacgccuaucugaacgguguggucgcccuggcccuccugaagaaguacccacagcuggcucccgaguucguguacggggaguacuugaaguucaacgcucacaaagccaacaaggccacagugaaaaaggaguucuacuccaacaucaugaaguucuucgagagcgacacgcccgucugcgacgagaacggcgagaucuucugggacaaauccaagagcaucgcacaagugaagaaggugaucaaccaccaccacaugaauaucgucaagaagaccgagauccagaagggcggguucuccaaggagaccguagagccaaagaaggacagcuccaagcugcuuccgcggaagaacaacugggaccccgcgaaguacggcgggcucggcagcccaaacguggccuacaccgucgccuucacguacgagaaggggaaggcccgcaagcggaccaacgcguuagagggcaucaccaucauggagcgcgaggcguucgaacaauccccggugcuuuuccucaaaaacaagggcuacgagcaggccgagaucgagaugaagcugcccaaguacgcucuguucgagcucgaaaacgggcggaagcgcaugguggccagcaacaaggaggcgcagaaggccaacuccuuccugcugcccgagcaccucguuacccugcuguaccacgccaagcaguacgacgagaucucccacaaggaguccuucgacuacgugaacgagcaccacaaggaguuuagcgagguguucgcccgcguucucgaguucgccggcaaguauacgcuggcggagaagaacaucgagaagcuagagaagaucuauaaggagaaccagaccgacgaccucgccaagcuggccuccagcuucgugaaccugaugcaguucaacgccaugggggcgcccgccgacuucaaguucuucgaugugacaaucccgcgcaagcgcuacacaucccucacggagaucuggcaaagcaccauuauccaccaaagcaucaccggcuuauacgagacccggauccgaauggggaaauga

SEQ ID NO: 7627 - RNA, 4023 nt, Artificial Sequence
  Cas9 variant
auggaacaggaguacuaccugggccucgacauggggaccggcagcguggggugggcaguuaccgacagugaguaccacgugcugcgcaagcacggcaaggcccuguggggcguucgacucuucgagagcgcguccacggccgaggagcgucggauguuccgcaccagccggcgccggcuggaccgccggaauuggcgcaucgagauccugcaggagaucuucgccgaggagaucuccaagaaggaccccggguucuuccuccggaugaaggagagcaaguacuacccggaggacaagcgugacaucaacggcaacugccccgagcugcccuacgcccuguucgucgacgaugacuucaccgacaaggacuaccacaagaaguuccccaccaucuaccaccuccggaagaugcugaugaacacggaggagaccccggacauccgccugguguaccucgccauccaccacaugaugaagcaccgggggcacuuucugcuguccggcgacaucaacgagaucaaggaguucgggaccaccuucagcaagcuccuggagaacauaaagaacgaggagcuggacuggaaccucgagcugggcaaggaggaguacgcgguggucgaguccauccugaaagacaacaugcucaacaggagcacgaagaagacgcggcugaucaaggcccugaaggccaaguccaucugcgagaaggccgugcucaaccugcuagccgggggcaccgugaagcucagcgacaucuucggccuggaggagcugaacgagaccgagcgccccaagaucuccuucgcggacaacggguacgacgacuacaucggcgaggucgagaaugagcucggggagcaguucuacaucaucgagacggccaaggccguguacgacugggccgugcuggucgagauccugggcaaguacaccagcaucuccgaggcgaagguggccaccuacgagaagcauaagagcgaccuccaguuccugaagaagaucgugcggaaguaccugaccaaggaggaguacaaggacaucuucgucuccacgagcgacaaguuaaagaacuacucugccuauaucggcaugaccaagaucaacgggaagaagguggaccugcagagcaagcgcugcagcaaggaggaguucuacgacuucaucaagaagaacgugcugaagaagcucgagggccagcccgaguacgaguaccugaaggaggagcuggagcgggagaccuuccuccccaagcaggucaaccgcgacaacggggugaucccguaccagauccaccuguacgagcugaagaagauccucggcaaccugcgcgacaagaucgaccuuaucaaggagaacgaggacaagcucgugcagcuguucgaguuccggauccccuacuacgucgggccccugaacaagaucgacgacggcaaggagggcaaguucaccugggccgugcgcaaguccaacgagaagaucuaccccuggaacuucgagaacguggucgauaucgaggccagcgcggagaaguucauccggcgcaugacgaacaaguguaccuaccugaugggggaggacgugcucccgaaggacucccugcuguacagcaaguacauggucuuaaacgagcugaacaacgugaaacuugacggcgagaagcucuccguggagcugaagcagcggcuguacaccgacgucuucugcaaguaccgcaaggugacagugaagaagaucaagaacuaccucaagugcgaggggaucaucagcggcaacgucgagauuacagggaucgacggcgauuucaaggccucccugaccgccuaccacgacuucaaggagauccugaccgggaccgaacucgccaagaaggacaaggagaacaucauuacgaacauugugcuguucggggacgacaagaagcugcucaagaagcggcugaaccgccuguacccccagauuacccccaaccagcucaagaagauaugcgcccugagcuacaccggcuggggucgguucuccaagaaguuccuggaggagaucaccgcgcccgacccagagacgggcgagguguggaacaucaucaccgcccucugggagagcaacaacaaccugaugcagcugcucuccaacgaguaccgcuucauggaggaggucgagaccuacaacauggggaagcagaccaagacgcugagcuaugagaccguggagaacauguacgugucccccagcgucaagagacagaucuggcagacccugaagaucgugaaagagcucgagaaggugaugaaggagucccccaagcgcgucuucaucgaaauggcccgggagaagcaggagagcaaacgcaccgagucccggaagaagcagcugauagaccuguauaaggccugcaagaacgaggagaaggacugggugaaggagcucggcgaccaggaggaacagaagcugaggagcgacaagcuguaccucuacuacacccagaagggccggugcauguacuccggggaggugaucgagcugaaggaccugugggacaacacgaaguacgacaucgaccacaucuacccccagagcaagaccauggacgacagccucaacaaccgcgucuuggugaagaagaaauacaacgccaucaaguccgacaaguacccacugaacgagaacauccggcacgagcgcaagggcuucuggaagucccuccuggacgggggcuucaucagcaaagagaaguacgagcgccugauccggaacaccgagcucagccccgaggagcuggcgggcuucaucgagcgccagaucguggagacccggcaguccacaaaagccgucgccgagauccugaagcaggucuuccccgagagcgagaucguguacgugaaggccgggaccgugucccgcuucaggaaggacuuugagcuccugaaggugcgagaggucaacgaccugcaccacgcgaaggacgccuaccucaacaucguggugggcaacagcuacuacgucaaguucaccaagaacgccuccugguucaucaaggagaaccccgggcggaccuacaaccugaagaagauguucaccagcggcuggaacaucgagcgcaacggggagguggcgugggaggugggcaagaaggguaccaucgucacugugaagcagaucaugaacaagaacaauauccuggugacgcggcagguccacgaggccaagggcggccucuucgaccagcagaucaugaagaaggggaagggacagaucgccaucaaggagacggacgagaggcuggccuccaucgaaaaguacgggggcuacaacaaggccgccggcgccuacuucaugcugguggagagcaaggacaagaaggggaagaccauccggaccaucgaguucauaccgcucuaccugaagaacaagaucgaguccgacgagagcaucgcgcugaacuuccucgagaagggccgcgggcuaaaggagcccaagauccugcucaagaagauaaagaucgacacccuguucgacguggacggguucaagauguggcuguccggccggacgggcgaccgccuccuguucaagugcgccaaccagcugauccucgacgagaagauuaucgucaccaugaagaagaucgugaaguucauacagcggcgacaggagaaccgagagcugaagcugagcgacaaggacggcaucgacaacgaggugcucauggagaucuacaacaccuuugucgauaagcuggagaacaccguguaucgcauccgacuguccgagcaggccaaaacgcucaucgaccgccagaaggaguucgagcggcugagccuggaggacaagagcuccacccucuucgagauucugcacaucuuccagugccagagcuccgccgccaaccugaagaugaucgggggccccgggaaggcggguauccuugugaugaacaacaacaucagcaagugcaacaagaucuccaucaucaaucagagccccaccgggaucuucgagaacgagaucgacuuacugaaaauauga

SEQ ID NO: 7628 - RNA, 4026 nt, Artificial Sequence
  Cas9 variant
augcgcuuccagaacaagaagaccggugacuacuucguggggcuggacaucggcacaaacagcgucgggugggccgugacgaacgagaaguacgagauccuccgggccaagaaccaccgcauguggggcucccggcuguucgaggaggggaagaccgcggaggagcgccgggugcaccgugccggucggcgccggcugaaccgccggaacgaccgccucaugauccuggaggacuuguucgccgaggagauuagcaaggucgacaaggcauucuaccagcgccuccacgagucccaguaccgccaggagcacaagaccgugagcggccccuacuuccuguucaacgacaaggaguucaccgacgaggacuaccacauagacuacccgacgaucuaccaccuccggguggcacugaugaaggcgcccgccaaggacguccgccugcuguuccucgccauccaccacaucaucaaguaccgggggaacuuccugcacgagggcgagaccuucaagaccaccgggggccugacggacauccuccaacgcgugcuggccugcaacgaguucucggggcugaagcagcacaucgacgacaccgcgcucgugaagcugcugaccaacaagggcaucacacggagcgacaucgccaagcagaucuccgagcucgccacggacaagcuguaccgcaagcaggccaaggccuucgcgagccugguccucggcuuaaaggccaaccuggacgaccucuucaacgagcccgaauacaaggagcuggacuccgagauccggaccguggaguucagcgggaaggaguacugggaggagcgcgauaaauacgagcccuaccugggcgagucgcuguucgcccuggacggcugcaagaccuuauacgacacccuccugcugagcaauaucaagccggacggcaaguaccucucagaggccaagguggagacguucgagaagcaccacgagcaccuggagagccugaaggaccuccugaaguccaacaaggcccuguacaaccgcguccuccgggacgacgagaagaaccugaacaacuacaucaccuacaucggcaagagcgaguucaacaagcgcugcucccgggacgaguucuacaaguuccugaaacagaccaucaaggacaucagcgauaacgagaacaaggcggagaucgugcagcucauggagcuggacaguuuccugccccuccugcgcgugcgggagaacggggucauccccuaccagauccacgaggaggagcuggagcagauccugaacgugagcagcgagaaguaccccuuccucaacaaggccgacggcuccggguucaccaucgcccagaagauccugaagcugcucacguuccgcaucccguacuucguaggcccccugaaccccgcccacaaggaccgggacaacggguucgccugggucgugcgcaaggcgcccggcaagguguacccguggaacuucgaggacaaggucgacaucagcgccuccgccaccgccuucaucgagaaucugaccaacaagugcaccuaccugaucggcgaggacgugcugcccaaguacagccuggccuacuccaaguucagcuugcugaacgagcugaacaaccuccgguacgaugggaagccccuguccuacgagacgaagcagagcuucaucaaggacugcuucgagaaggagcaccgcaagaugaccgaaaagcggauccgcgaguuccugaagcaccucggagggaccgacggcaagggagcgcugacuggccuggauguggacaucaaguccgaccucaagagcuaccgggacaugguccgcauucugggcgacggguucgacgagacgauggccgagcggaucauccgcuacgugacccuguucggcgaggccaagaagguccuccuguccacccuggagauagaguucggggacgaccucagcgacacacagaagaagcagauccugaagcugcaguaccgggacuggggccgccucuccgccacucugcugaaggggaucaagggcguggcgggcgacaaccccgaaugcagcauccucgagugcauggagcagcagccgcugaaccugauggaggugcucuccagccacaacaccuaccuggccgcuaucgaggaguucaacaaggaacggaccgagcccaccgacaucgucgacuacaagcugguggacgaccucuacaucucccccgccgugaagcgcagcgucuggcagacacugcgcauccuggaugagaucaccaaguuacggggguccgugcccaagaagguguucgucgagguggcccgcacgaaccgggcggagaagaagaagaccgacagccgcaaggagcggcugcugcagcucuacaaaaccaucaaggacgagggccgcaacuggacggaggagaucaagcaacgggacgccggggacuucaacagcaagaagcuguuucuguacuacacccagcagggacgcugcauguacucaggcgagaagaucaccagcauuggggaccucuucaccuccaaguaugacaucgaccacaucuacccgcggagcgugacgaaggacaacuccugggacaaccugguccuggugaaggccgagcucaaccgcgagaagaaggacaucuacccaaucgagaaggacacccaggaccggugcaucagccuguggaagcagcugcucgagcagggccugaucuccgaacgcaaguacgagcggcuggugcgcaccacgccccugaccgccgacgagcuggccgacuucgucaaccggcagcugguggagaccaaccagagcguaaaggcggucaccaaccuccugaagcgccuguaccccgacaccacgaucugcuacgugaaggccgagaacguguccgacuucaggcaagagcgcgaguucgucaagcuccggagccugaacgcccaccaccacgccaaggacgccuaccugaacaucgucguagggaauguuuaccacgagaaguucaccaacaacccgcgcaacuucaucaagaaugcgcgguccgacaagaagcgucccuacagccucaaucacauguuugacuaccugcuccagguaggcaacaaggagaucuggaaccccaagaccgacaacaaccuggugaagaagaugaugcgcaacaacgacguccaggugacccggaugcugguggagcagacgggagcccuguacgacgccaccaucuacaaggccuccgucaccaagagcgaguccuacgugccccucaagagcuccgacgcgauccugagcgacgugaagaaguauggcggcuucaccagcaucaagaucgccuacuacuccaucuuccgcuucuacaagaagaacagcgaggaguucgagacucacaucaucuccaucccgguccugaaggccgggacccucaacagcaaggaggacuacguggccuacggcgaggagaucaugaacaagcagaaguucgaccggguggagcuggucuacaagaagcugugcaugaacucccucgugcgcaucaacggggugauguacuaccugggcgggaagaccaacaacagccuguacaucgacuccgccauaagccucguccugcccgacaacaucgcgaagaagaucaaggccguggagaaguacaucgcccggguggccgagaacggcaacuacaagccccagccggaccaggucucccccgaguucaacaugaucaucuacaaggcccugaccgagaagaugaagcaacccgcguucgugggccucaagacgaaucgcgagaaugagcuggagaaggagaccaccaucaccgccuucaucgccaugacgcugaucgagcagugcaagaugcucauggagauucugaaccugcucacccagcagaagaccaccuacgcccugaagcccaucgggguaagcgccucccggagcacgcuaggcaugaacaucacagggcucuccgaguucaccaucaucacccagagcgucacgggccugcaggagaaggagauccgcaucaucuga

SEQ ID NO: 7629 - RNA, 4026 nt, Artificial Sequence; identical to SEQ ID NO: 1829
  Cas9 variant

SEQ ID NO: 7630 - RNA, 4026 nt, Artificial Sequence
  Cas9 variant
auggagaaggacuacuaccugggccucgauauggggagcggcuccgcugggugggccgugaccgacgaccaguaccacgugcugcgcgcgcacggcaaggccaugugggggacccggcuguucgagagcgccaacacggccgaggagcgccggaucaaccgcaccgcccggcgccggcucaaacgccguaaccagcgcaucgaguggcugcaggagaucuucgcggaggagaucaacaccaaagacuccggcuucuuccggcgcaugaaggagucucgguacugggccgaggacaagcgcgacgagaauggcuccugccccgagaugccguacagccuguucaucgacgaggacuucaccgacaaggaguaccacgagaaguuccccacgaucuaccaccucaggaaguaucuaaugaccaccgaggagacccccgggauccgccugguguaccucgccuuccaccacaugaugaagcaucggggccacuuccugcugaacgggaacaucgaggagauccgcaaguuccggaagacguucgaccaguuccucgaggugguccgcaacgaggagaugggcuucgccggcgagaucgaggaggagaccuacaagaagaucgagaugacccuuaaggacgugaaccugacccgguccgcgaagaagacgacccucaucaagagccugaaggugacccgcgucgaggagaaggagcugcucgcccugaucuccggcugcacagucaagcugagcaacaucuucaacgacaagucccucgacgagacggagcgccccaagaucagcuucgccgacgccggcuucgacgacuacgaggccgagauccaguccaaccugaacgagaaguacuacaucauugagagcgcgaaggccguguacgacugggccgcccuggccgacauccucggggaguacaguugcaucagcgaggcgaaggucgccuuauacgagaagcaccacaaggaccugaagcggcucaaggaccuggugcgcaacaacaucuccagcgaggucuacaaggagaucuucgucgacguguccggcaaguacaagaacuacugcgcauacaucgggaccaccaacaucaacggcaagaagaaggacuucgagggcaagaagugcaccaaggaggacuucuacgccuaccugaagaaauccgugaucgagugcaucaacgacagcgagaagaccgacuggcucaagcuggagcuggagaagggaaacuuccucccgaagcaacugaccggcgagaauagcgucauccccuaccaggugcaccuguacgagcucaacgccauaaucaccaaccugcaggagcggaucccccugcucaagcgcgacggggagaagauccggcagaucuucaccuuucgcgugcccuacuacgucggcccgcugaacgggaucagcaucgacggcaagaagacgaauuggguuaagcggaaggaaggcgugaucuaccccuggaauuucagcgacaucgucgacgaggagagcuccgcggagagcuucauccgccggaugaccaacaagugcaccuaccugauccacgaagacgugcuccccaaguacagccugcuguacagccgcuucgaggugcucaacgagcugaacaacguccggcugaacggugagcuccuguccguagagcugaagcagaagaucuacgaggacgucuuccagagauaccggaaggugacccagaagcgccugaagcgguaccuccugacggagggcaucaucgacgagaacaccgugaucaccgggcuggacggcgacuucaaggggagccucaccgccuaccacgauuucaaggagaagcugacgggccugaaccucaccgagcgcgagaaggaggagaucauccugaacaucacccuguucggcgacgcucggucccuccugcgcaagcggaucgggaaaaucugcagccagcuguccgacaagcagaaggagaaccucagcaagcuguccuaccagggcugggggcgccugagcaagaaguuccucaacggcaucgccaucuccguccagggggaggaggaguggaccaucaucaaggcccugugggaaacgcaggacaaccuuagccagcucaugggcgcgaaguacaccuuccgcaacgccguggagaaggagaacggcgagcuggagaaccgggagaucuccuacgagaccgugaaggaccucucgaucagccccuccgucaagcgccagguguggcagagccuccugaucgugaaggagaucugcaagauccaaaagaagccgccccggaaggucuucguggagguggccaaggagaagaccaacuccgggcgcaccgagagccggaagaagcgccugcaggacuuuuacaaguacugcaguaaguacgagaaggagcucuacgacgagagcauccagaacaaacuggagaagugcuccgagagcgaccugcgguccgacaaguuguuccuguacuacaugcagaugggccgcuguauguacacggggcagcccaucgacuucgacgagcuguggaacaaccagaaguacgauaucgaccacaucuacccccagagcaagaccauggacgacuccaucgacaaccggguccucgugaagcgcaucagcaaccaggagaagaccgacguguacccgauccgggccgacauacgcgagaagcggcgcggcuuuuggaaggagcugaagaacgucggccugauauccgaggaaaaguacaagcggcucacccgcgcaacggaguucgaacccgccgagcuggcaggguucaucagccggcagcugguggagaaccgccagaccaccaagguggucgcauccauccucaagcaggccaugcccgacaccgagaucguuuacgugaaagcgcggacggucagcgaguuccgccacaaguucaacuucaucaaggugcgggagaugaacgacuuccaccacgccaaggacgccuaccugaacgugguagugggcaacaccuaccuggugaaguucaccaagucccccgucaauuucaucgagaaccacagcaaccgcucguacaaccucaaaaagauguuuaccgacgggcgcguggagcggaacggcgagaucgccuggaucuccggggagaacggcacgaucggcaccgugcgcaacauaaugaagaagaacaacauccuggucacccggcgcgcccaugaggcgaccgggggcuucuucgaccagcagcugaugaagaaggggaagggccaggugccggugaaggggagcgacgagcggcuccuggacaucgagaaguacggaggcuacaacaaggagacgggggccuacuucguccugguggaguccgacgagaagaagggcaagaagaagcgcaccaucgaguacgugcccauccggcucaagaagcagcuggagaacaaccgcaaggcccuugagaacuaccucugcgagcagcgggggcugaccaaccccgucgugcugaucgacaagaucaagauggacagccucuuccgcguggacggcuucuucauguggcuguccgggcggaccggcaaccagcuccucuucaagugcgcgaaccagcugguccugagcacggaggacgaggccacccucaagaaaaucgugaaguucgugaaccgccggaaggagaacaaggagaucaagaucuacgaguccgacaaacuuaacgaggagaugcucaaccgccucuacaacaccuuccuguacaagcugcagaacuccaucuacggcaaccggcucggggagcaggcgaagacccuguccagcaagaaggagaacuucgacaagcugcagaucgaggagaagugccucguccuguacgagauccugcacauguuccagugccaguccgccacgagcgaccuccagcuaaucgagggccccgggaaggccgggacccugcgccucaacuccaacaucaccaaauacaagaacaucaacaucaucaaccagagcccgaccgggaucuacgaacaggucaucgaccugcagaagaucuga

SEQ ID NO: 7631 - RNA, 4026 nt, Artificial Sequence
  Cas9 variant
augggaaagggguacuacguggggcuggacauggggacaggcucggucgggugggccgugaccgacgagaguuaccagauccuucgccggcacgguaaggccauguggggcgugaggcuguucgagagugcgaagacggccgaggaacggcgcauguuucggacugggcgcaggcgccuggaccggcguggcuggcggaucgagauccuccaggagaucuucgccgaggagaucuccagggucgacccgggguucuuccugcggaugaaggagagcaaguacuacccggaagacaaacgcgacauccagggcaacugccccgagcugcccuacacccucuucguggacaagacguucacggacaaggacuuccacaagaaguaccccaccaucuaccaccuucggaagaugcucauggagaccgaggacaccccggacaugcgccugguguaccuggcucugcaccauaugaugaagcaccgggggcacuuccucuuguccggcgacaucagccaggucacggaguucaagaacaccuucaaucaguucaucgagaauauacgcaacgaagagauggacuucgagaucgagcuggacgagucugccgugcagaugaucgaggaaacccuuaaagacaagaaccugacccgcagcgcgaagaaauccaaguuagugaagggccucaacgcuaagaacguccgcgacaaggccuuccugacgcugcucagcgggggcaccgugaagcuguccgaccuguucgggauggaggagcucaacgagggcgagcggcccaagaucagcuucgccgacaacggcuacgaggaguacgcggccguggucgagauggagcucggggagcuguacuauaucguggaguccgccaaggccguguacgauugggcaauccucagcgacauacugggcgggucgaccagcgucuccgacgcgaaaguccgcgccuacgagaagcacaaggccgaccuuaaguaccucaaggccguggucaaggaguacuuccccaaggagguguacaacgcaguguucgucgagagcuccgauaagcugaacaacuaccccgcguacaucgguaugaccaagaaaaauggaaagaaaguaagccuggagggcaagcgaugcagccgggaggaguucauggacuuccucaagaagaacaucguggugaagcucccggacgaggaggccaagauguacuugcaguccgagcucgaaaaggacagcuuccugcccaagcaagucaacaaggacaacggcgugauucccuaccaggugcacaaguacgagcugaagaagauccucgacaacuuaggggauaagauccccuuucugaaggagaacgccgagaagaucgagaagcuguuuuccuuccgcaucccguacuacguuggcccccugcggacggggaacggcgagaauagcaaguucgcgugggccgagcgcaaguccaccgagaagaucuauccguggaacuucgagaacgucaucgacguggagcagagcgcggagaacuucauccggcgcaugacaaacaagugcaccuaccugaucggggaggacguccuccccaaagauucccuucuguacagcaaguucaugguccucaacgagcugaacaauuuacggcuggacggccagaagaucuccguggagcucaaacagaagauauaccgcgauguguucugccggagccgcaaggucacgcagaagaagcugaaguccuaucugauccgggagggcaucgccgggaagaacguggagcucaccggcaucgacggagauuuuaaggguagccugaccgccuaccaugauuucaaggagaagcugaucgacguagagcucacccagaaagagaaggaggagaucauucugaacaucgugcuguucggggacgacaagaagcuccugaaacagcgccugaagaagaaguucccgcagcucacggagaagcagaucaacaccgugaccgcccuguccuacaagggcuggggccggcugagcaagaagcuccuggaagaagugacaguccccgcgccagaaacgggggaaguguggaacaucaucaccgcgcugugggagaccaacgacaacuucaugcagcuccuguccaaggaguaccaguucagcgaucgcaucgaggaguucaacgaagagaaggccgaccccgagguguccuaccagaccaucgaggaccuguauguaucgcccgccgugaagcggcagaucuggcagacgcuccagaucauccaggagaucgaaaaggugaugggcgagaaacccaagcgcgucuucguggagauggcccgggagaagcaggagaacaagcgcaccgagucccguaaaaagacccuauccgaccuguacacgaagugcaagaaggaggagcccgaguggaucgaggcgcucugcacgagccuggagaagcacgaagaacaccagcugcgcuccgacaagcucuaccuguacuacacccagaaggggcgcugcauguacagcggcgagccgaucgaucuggaggaccucugggacaacaccaaguacgacauugaccacaucuacccgcaguccaaaaccauggacgacagccuuaagaaccggguguuagucaagaaggaguacaacgccaagaaauccgacaccuaccccaucgccgccgauauccagaagaaaaugaugcccuucuggaaaucccuccucacgggcggguucauccccaaggagaaguaugaccgccuggugcgcaacaacccgcucgacgccaacgagcuggcgggcuucaucgaacgccagaucguggagacccggcagagcaccaaggccgucgccgagauccuaaagaagauccuccccgacaccgagaucguguacgugaaagccaagacagucagcaaguuccgccaggacuucgacuuuaucaaagugagagacaugaacgaccugcaccacgccaaggacgcuuaccugaacauugugguggggaacguguacuucgugaaauucaccaagaacgccgccugguucgucaaggagaacccuggccgcaccuacaaccucgaaaagauguucaucugggacguggcccgggacggagagaucgccuggaaggcgggcaaaucugggagcauuguacagguccgcgcaaugauggagaagaaccacauccuggugacccgacgcuccuacgagguaaagggcgggcuuuuugaccagcagauccuaaagaaggggaagggccaggucccggugaaggagagcgacgaacggcugcgcgacaucgggaaguauggcggcuacaacaaggcugcagggguguacuucaugcugguguccagcaaagacaagaagggcaaagagcagcggacgaucgaguucguucccaucuaucucaaggaucgcguggagaaggacauggaguccgcgcggaacuaccugauggaggagcgcgggcugcgggaaccaaagauccucaucaagaaaaucaagaucgacacccuguucaaggucgauggcuucuacauguggcugagcgggcgcaccuccaaccagcucauuuucaagggcgccaaccagcugauccuguccaaggaggacaugaagacccucaagaagguggucaaguacauccagcggcagaaggaagacaagaacgucaagauaagcaugcgugacggcauaacggaggaggaacugcugaagcuauacgagacguuucuggacaagauccgccacucaaucuacggggcccggcuguccucccaggagaaaacccucgucaacggcaaggagaaguucaucgaccugagcgucgaggccaagugccaggugcuguacgagauccuccaccuguuccagugccaguccggugccgcgaaccuuaagaugauuggcgggcccgcguccgccggcauccuggugaugaacaacaacaucuccaaaugcaaaaacaucagcaucguaaaccagagcccgaccggcaucuaugagaaggagaucgaucuacugcgcguuuga

SEQ ID NO: 7632 - RNA, 4026 nt, Artificial Sequence; identical to SEQ ID NO: 1832
  Cas9 variant

SEQ ID NO: 7633 - RNA, 4032 nt, Artificial Sequence
  Cas9 variant
augaccuacuaucuuggccucgacaugggaaccagcuccgugggcugggccgucacggacgagaacuauaaccugauccaccgccaccggaaggaccuguggggcauucgcgaguucgaggaggccaagaccgcgguggagcggcggacgcagcgcaucagccgccggaggcggcaacgcgagguugccaggaucggccuccugaaggacuacuuucacgacgagauccagaaagucgaccccaauuucuaucagcgccuggacaacuccaaguacuucccggaggacaaggaagagguggugaaggggaagaacggcaucuuugccgaugagaacuacaccgaccgggacuacuucgccgaguacccgacgaucuuccaccuccgcagagagcugcugaacagcaaggagccccacgauguucggcuccuguaccuggcccuccugaacauguacaagcaccggggccacuuccugaacaccacccucggcaccgacggggagaaccgcaagcuguccgacgucuaccgggacuucguggucaagacggaggaggugcuggggcucaccuucccccaggagaccgacaacggcaagaugcaggagaucaugugcucacgcgaguuuucccggaagcgcaaggcggagcugcugugcgcccuccuggagaucgauaagaaacagaagcagcaggucgccuugaucgagugcgugcucggccuggacaagucggugaagcagauguacggcaccgccgugccggaugacuucgacaaguccgucaaggugaacuucagcgauuccuccuucgaggagaagguguccgaaguagaagaacugcucgacgaggagaaguacgagcugauccugugcaugaaggaacucuacgacacggcggugcuaaaccagaucaugggcgacugcaacuaccugagcgaggcccgcgugcaagaguacgagaagcacaaggaggaccucaaguugcuuaagcguaccgucaagaaguacgggaccgccgaggaguaccaguuccucuuccgcuccagcgagaaagccuccuacaacgccuacgugcacagcgugaacuccggcgagaagauucggcgcaacauggacgggcggucgcgcgacgaccucuacacaguccugaagaagauguuaaagaacuacccccaggaggacgcggacugcaaguacauccuggaggagaucgagaaggagcaguuccugcccaagcagcuugugagcgacaacggcgucauccccaaccagauccacuacaaggagaugaagaagauccuggagaacgcagaacaguaccugcacuuccuccgggagaaggacgaguccggauacacgguggccgagcgcauccugaagcuguucgcauuucagaucccauacuacaucgggccaaccagcgagaaguccggcaaaaacgggggcaacgggugggugguccggaaggagcagggccaggugcuccccuggaacaucgaggagaaaaucgacaugaaagccaccagcgagaccuucaucucccgcauggugcgucgcugcacguaccuuagcgacgagaugguccugccgaaggcgucucuggaguacgagagcuucugcgugcucaacgagcugaacaaccugcggauccgcggcgugaagcuaccgaucacagucaagcaggacaucuacaaggaccuguucgaacgggggaagagagugacccggaagcagauagugaacuaccuaaagggcgucgggauccuccaggagggcgaggaggacgagcugacugggaugauggacacguucaacuccagccuggccuccuauggcaaguucaagagcauccucggcgagaagauacaggaggacuccugcaagcgcaugguggagcaaauuaucuucuggugcaccaucuauggggacgccaagaaauuccugaaggagcagcuggaggagaaguacggcgacgugcucacccgggagcagaucaagcgcaucuuaggguuuaagcugaaggacuggggcaaccucagcaagaaguuccuggagcugaacgggugcgaccgcaacaccggcgaggucaugucccucauccggaugcugugggagagcgacgacaaccuuauggagcuccucaaggacuccagcuacaccuaccgcgccgagcuggaggagcagcaggagaagcucaccaagacccugaccgagaucugccccgaggaccuggagggcuacuacuucagugcccccguaaagcggaugaucuggcagacgcucuuaauccugaaggagguggagaaggucaugggggagcccccgaagagaguguucguggagaugacccgggagcacgacgagcgccgagagaugaaggacagccgcggcaagaaguuccaggagcucuacaagaacaucaaggaugaggagcacaauuggaaggcagagauugaggacgccgagaaggacgggcggauccgcagcaagaagauguaccuguaccuuacccagcggggccgcugcauguacaccggcaaccccaucgaccucgaggaacucuucacgaccaaguaugacaucgaccacaucuacccccggcacuucgucaaggacgacaaucuggacaacaaccucgugcugguggaaaaggagaagaacgcccacaaguccgaccaauacccccugggggacgacauuuacaccggccgccucagcugguggaaagaguuacaccgggagaagcugaucaacgacgagaaguacaagcgccucaccgggcgggccccguucuccgacgagcagaaggccggcuucaucgcccgacagcuggucgagaccagccaggggacgaagggcguggccuccaucuugaaggaaguguugcccgagaccaccaccaucgucuacgccaaagcccggaacgugagcgacuuucgcaacacgaacgagcugcugaaggcgcggucggugaacgacuuccaccacgcccaggacgccuaccucaacaucguggugggcaacguguacuacgucaaguucaccaacaacccccugaacuucgugcgcucaggggagggcuacaaucuggacgggguguuccgcaaaaacgucauccggggccaggagaacgccuggauagugaagcccgagaagggggagaagaugacccucgagaccgugaagcgcgucauggccaagaacaccccgcugcugacccggcucuccuucgagggccguggcgggcuggcgaaccaaacccuguacagugccaaggaggccgccggugagggguacgugccccucaaguccagcgacucccggcugcaggacgugaccaaguacggcggguucacgagcgucaccaccgcguacuucauccuggucgagcacgacaugaagaagaagcgcgugcggaccaucgaguccguccccauccucuggaaggagcgcauugagaaagagagcggacagcuggagaucuacugucgggaggcccugggccucgugaaccccgacauccgcgugcggaagauccugauccagagucuggucaagaaagacggguuuuacaugcaccucagcggcaagacggggaaccgcuucaucaugcggaacgccguggagcugugccugaagcaggaguggaucaacuacagcaaaaagcucgagaaggaaggcugcgaugaguccaucaccaaggagaagaacgaggagcuguacgagauccuaaaggagaagcauaucaacgggaucuaucgcaagcggccuaaccccaugggcgagaagcuccacauacgccaagagaccuuucggaugcugacccuggaggagcagaagaaagugcuccugagccugcuuaaccugacgaagaucggccccgucgaggccaaccuggagcucauaggcgaguccgcgcacacaggcaagauguugaucagcaagaacaucaccgaggugaaggaguuuuacuugauccaccaguccgucacugggaucuacgagaagcaagucaaccuccugacgguguga

SEQ ID NO: 7634 - RNA, 4032 nt, Artificial Sequence; identical to SEQ ID NO: 1834
  Cas9 variant

SEQ ID NO: 7635 - RNA, 4035 nt, Artificial Sequence
  Cas9 variant
augagccagaacaacaacaagaucuacaacaucggccuggauaucggggacgccuccgugggcugggccguuguggacgagcacuacaaccuccugaagcgacacgggaagcacauguggggcagucggcuguucacccaagccaacaccgccguagagcgccgguccagccgcuccacgcggcgacgguacaacaagcgccgggagagaauccgacuccuucgcgagaucauggaggacaugguccuggacguugaccccaccuucuucauccggcucgccaacgugagcuuccuggaucaggaggacaagaaggacuaccugaaagagaacuaccacuccaacuacaaccucuucaucgacaaggacuucaacgacaagaccuacuacgacaaguacccgaccaucuaccaccuccgcaagcaccugugcgagagcaaggagaaggaggacccccggcucaucuaccuggccuuacaccacaucgucaaguaccgcgggaacuucuuauacgagggccagaaguucuccauggacgugagcaacaucgaggacaagaugaucgacgugcuacggcaguucaacgagaucaaccuguucgaguacgucgaggaccgcaagaagaucgacgaggugcucaacgugcuuaaggagccccugucgaaaaagcacaaggccgagaaggcguucgcccuguucgacacgaccaaggacaacaaggccgccuacaaggagcucugcgcggcccuggccggcaacaaguucaacgugaccaaaaugcucaaggaggccgagcuccacgaugaggacgagaaggacaucagcuucaaguucuccgacgccaccuucgacgacgcguucguggagaagcagccccuguuaggggacugcguggaguucaucgaccugcugcacgacaucuacagcugggucgagcuccagaacauccugggcuccgcccauaccagcgagccguccaucagcgccgccaugauccagcgauaugaggaccacaagaacgaccugaagcuccugaaggacgugauccgcaaguaucuccccaagaaguacuucgagguguuccgcgacgagaaguccaagaaaaacaacuacugcaacuacaucaaccacccuagcaagacccccgucgacgaguucuacaaguacaucaagaaauuaaucgagaagaucgacgacccggacgugaagaccauccugaacaagaucgagcuggagagcuucaugcucaagcagaacucccgcaccaacggggccgugcccuaccagaugcaguuggacgagcuuaacaagauccucgagaaccaaagcgucuacuacuccgaccugaaagacaacgaggacaagauccgcuccauccugacguuccggauccccuacuacuucggcccccucaauaucaccaaggaccgccaauucgacuggaucaucaagaaggaggggaaggaaaacgaaaggauccugccguggaacgcgaacgagaucguggacguggacaagaccgccgacgaguucaucaagagaaugcguaacuucugcaccuacuuccccgacgagccggucauggcaaagaacucccugacggugagcaaguacgaaguccucaacgagaucaacaagcuaaggaucaacgaccaccugaucaagagagacaugaaggacaagaugcugcacacccucuucauggaccacaaguccaucucagccaacgccaugaagaaguggcuggugaagaaccaguacuucuccaauacggacgacaucaagaucgagggcuuccagaaggagaacgcgugcagcaccucccucacgccauggauagacuuuacuaagaucuucgggaagaucaacgaaagcaacuacgacuucaucgagaaaaucaucuacgacguuaccgucuucgaggacaagaagauccuccgccggcgccugaagaaggaguacgaccuggacgaggaaaagaucaagaagauucucaagcugaaguacuccggguggagccgucuguccaagaagcuccugagcggcaucaagaccaaguacaaggacuccacgcgcaccccggagaccgugcuggaggugauggagcggacuaacaugaaccuaaugcaggucaucaacgacgagaagcugggguucaagaagacgaucgacgacgccaacucaacguccguaagcggcaaguucagcuacgccgaggugcaggagcuagcgggcucccccgccaucaagcgcggcaucuggcaggcguugcuaaucgucgacgagaucaaaaagaucaugaagcacgaaccggcccacguuuacaucgaguucgcccggaacgaggacgagaaggagcgcaaggacagcuucgugaaccagaugcugaagcucuacaaggacuacgacuuugaggacgagaccgagaaagaggccaacaagcaccugaagggcgaggacgcgaaguccaaaauccggagcgagcgccugaagcucuacuacacccagauggggaagugcauguacacgggcaagucccuggacauugaccggcuggacaccuaccaggucgaccacaucgugccccagagccuccugaaggacgacuccaucgacaacaaggugcuaguccucagcuccgaaaaccagcgcaagcuggacgaccuggugaucccgaguuccauccgcaacaagauguacggguucugggaaaagcuguucaacaacaagaucaucagccccaagaaguucuacucucuaauaaagacggaguucaacgagaaggaccaggaacgguucauaaaccgccagaucguggagacccggcagauaacgaaacacgucgcccagaucaucgauaaccacuacgagaacaccaagguggugaccguccgcgccgaccugagccaccaauuccgggagcgcuaucacaucuacaagaaccgggacauuaacgacuuccaccacgcccacgacgccuacaucgcgaccauccucgguaccuacaucgggcacagauucgagucccuggacgcuaaguacaucuauggggaguacaagcggaucuuccgcaaccagaagaacaagggcaaggagaugaagaaaaacaacgacggguucauccugaacagcaugcggaacaucuaugcugacaaggacacgggcgagaucgugugggaccccaacuacaucgaccgcaucaagaagugcuucuauuacaaggacugcuucgugacuaaaaagcucgaggagaacaacgggaccuucuucaacguaaccgugcugcccaacgacacgaacuccgacaaggacaacacccuggccaccgugccggucaacaaauaccguagcaacguuaacaaguacgggggcuucagcggagucaauuccuucaucguggcaaucaaggggaaaaagaagaagggaaagaaggugaucgaggugaacaagcucaccggaaucccccugauguacaaaaacgcggacgaggaaaucaagaucaacuaccugaagcaggccgaggaccucgaggagguccagaucggaaaggagauccugaagaaucagcugauagagaaggacggcggccucuacuauaucguggcccccacggagaucaucaacgccaagcagcugauccugaacgaaagccagaccaagcucgugugcgagaucuacaaggccaugaaauacaagaacuacgacaaccuggacuccgagaagaucaucgaccuguaccgccuccugaucaacaagauggaacuguacuaccccgaguaccggaagcagcuagucaagaaguucgaggaccgcuacgagcagcugaagguaaucagcaucgaggagaagugcaacaucaucaaacagauccuggccacccuccacugcaacuccagcaucgggaagaucauguacuccgacuuuaagaucagcaccacgauaggccggcugaacgggcgcaccaucagucuggacgacaucucauucauagccgaguccccgaccggcauguacagcaagaaguauaagcucuga

SEQ ID NO: 7636 - RNA, 4035 nt, Artificial Sequence
  Cas9 variant
augaagaagaccaaccccuacauccugagccucgacaucgggaccgccuccaucggcuacgcuugcauggaccuugauuucaacauccugaaguaccacgacaaggacgccaucggugugcucacguucgagggggccgacacugccgccgagcgccggggauuccggaccagccggcgccggaaaaaccgccggaucaagcgccuaggucugcuccaagagguccuagcuccgcuggugaagaaccccaacuacuaucagcuccugaaccugcacaaguggaagaacuccaacgaggauuucaagcaccggagccucuccgaggugcugaagauccugggcaagaacccaaagaccuacccuaccaucuaccaccuccaacaggacauucagaaccacccggagaagaaguucgagcccgagcugaucuuccuggcgcucuaccaccuggucaaguaucgcggccauuuucuguucaacaaccuuagcuucgacaaggggaagaccguggacaacgaggcccagcuguccgagcugcucgagcaguaccagagcaucaaccccuacgaggacuccaucagcaacaaggacauuaacgugauaguugacacccugaaggacgaucagcugacccguaacgacaaguccaaggagcucaagcguaacgugagcaagacgcacgccgagcuguucaagaugcuggugggccucaaguucaagcaauccauccuguucgagaacauggagaacgccgaggacaucaaggagagcgcgaccggguccgacgcuauuagccuguccgacgacuacuacgagaaccucagcgaguuccugaccgacgagcagcugaacuucaucgagucggcuaacaccuucuucaugggcauuaugcucgaccggauccugaagggggccacgagcaucagcgccgcgaagguccgcgacuacaagaucuuuaagaaccaguuaaaaauaaucaaggacaucguguaccagaacaaguacgacaaguaccacgaguucuucgugaccuccaaagaggacaugcgggcauaccaggagaaccccgaugccaagaccuucggcaagcucagcaaguucgaccaguaccugauccacccgaaggaccaguacgccaagcugaugaaggaccucaagggcaucguccccaagaaauacaccgaggugcugaaccugauugacgagcagaaguuccuuguaguacagaacacgaccgacaacgccagcauacccuaccagaacaacgucuucgaggcggagaacauccugcgcaaccagcagaaguacuaccccgagaucaccgaggagaugaucgggaaggugaucaaccugaucagcuuccggaucccguacuacgucggcccccucaccaacaaaaacggccaguccgacuucgccuggaugauccgcaagagugaugagcaaacgcugcccuggaacuucgacaaggugaucgacaaguccaagagcgccgagaaguucauccggcgcaugaccuccaaaugcaccuaccugcuggaggaggacgugcuccccaagcacucacugcuguaccaggaaauggagguccucaacgagcugaacaacgugcagcugcggggcgagaacgaaccgaagcaccgcauccaccgccucgaccccaaggucaagcaguucaucuaccauaaccuguuccagaagaagaagaacgucacccacaaggaccugaucacgcuucugcagaacuccgaacaccggaacacccugaacaaaacuagcggccagaagcuaaagguguucgguacccagaacgacuccaaguucgccagcaagcuguccaccuacaaugacaugaaagcaaucuucggcagcgucgaaaacaagcgucagaugaucgaggagcucgugcucuggaucaccauauucgaggacaaagcgauuuuaaagcagaaaaucggggagaaguaccccaacaucaccgaaaagcaacugaaccagaucgugaagcucaacuacagcgggugggggcggcugagcgagaagcugcucacaaaggaggugaacggccgcuccuuaauugaccugauguacagcacggagaauaacuucauggagaucaucacugacaagacccucggcuucgacugcuucaucaagaacagcaacaaggugaagaacgccaagaucuccuacaaggacguggccgagcugcggaccagccccgcccuaaagaaggggaucuggaacgccauaaagaugguccgagagauuuccgaccucuucggcgcgccggagaagaucaucaucgaguucgccacggaggaccaggugaaggggaagcggcagaaaagucgcagcgagcugugggacgaccuggugaagaagaacaaccucaagcggaacaagaaguucaagggccuguucgaggagcugaaggccuacccugaccucgacuucagcaaccccaaacuauggcuguacauccaccagaacgggaagugcauguacacgaagaagcccaucgacuuagagcgccugauguccgacaccaacaaccagcuguacgagaucgaccacauccucccgcggaccuucgucaaagacgacagcaucaacaacaaggugcuggugauccaguccgccaaccagaaaaaguccggugacaagaugccccuggagauuuucgacaaccacguccuagugcccuucuggaagaugcuguacgaaaacgaccugaucagcagcuccaagcucaguaagcugaugaagaaggaguucaaugaucuggacaaggagggcuucauccagcggcagcucguggagacccggcagauuaucucccacgucuccgacuuccugacggaggaguaccccuccaccaccguggugccgaugaaagccaacgucguaucagagcugcgccggaaguucgacauaccgaagauacgccagcucaacgacuggcaccacgccguggacgccuaccugaacggauucgucuaccaggccgcuagaguguucuaccccaaggugaaccuguucgaguucaacuucaagugggagaaggugcgcgagaaguggcggcagcucggcgaguucaccgagaacaacaaaaagcgcgaguuuuuccuguucaagcgcauggagaacuacgugaaugagcacggcgagggcaugaucagcaagcugaucuucgaccucgacaacuucaaguucaacuacucccgaaaaguggagagcacugaguccgcguucuacaagcagagcgccuucuccccgaagaacaccaccgcccaauacgacagcgacaagaacaagaccgccaucuacaaggagaugaagaacaagcgcgggaucgucguuuccuacacguacgugaagaaggaccaggaacugaucggcuacggcgucuucaacgagacgguguucgaguacgugaauaacgcggacgucgacaugaacacccgggcgcugaaaaucgugcgcaaggcuuuccccaagcucgacaucaagaaggcucaguaccuguucagcaucaacaagggggacgcccuguuggugaacggccaccccuuccuguucgucuccgccaaggagcggaucaacgggaagcagcuggaguucgacaucaacaugcagcgccggcucaagaaggcgcugcgccccuacaacaagaugaccgaacaggaaaaggugggcguguacaaucaguucgccgagaaggucgugcaggaguacgagaacagucugggcgccaagacgcggaacgagaagcucgagcugauccgcaaccaguucaacgaguccgacaagucaaacgaggcccugauccagugcauccucgaggugcugaagaugaccaaggucuccgcggagcggagcgugaaacugaagauccgcuggggcucccagaccccgaacacacuaaucgacaucaacaacaaggcaaagaucauguacaacagcaucacgggccugaagcagacccggcugaaguccaucuacaagcucgccgagagcaagaacgagcuguga

SEQ ID NO: 7637 - RNA, 4035 nt, Artificial Sequence; identical to SEQ ID NO: 1837
  Cas9 variant

SEQ ID NO: 7638 - RNA, 4035 nt, Artificial Sequence; identical to SEQ ID NO: 1838
  Cas9 variant

SEQ ID NO: 7639 - RNA, 4038 nt, Artificial Sequence
  Cas9 variant
augaagaagcccuacagcaucggccuggacaucgggaccaacuccgugggcugggccgucgugaccgacgacuauaaggucccggccaagaagaugaagguccucgggaacacggacaagagccacaucaagaaaaaucugcugggcgcgcuccuguucgacucagggaacaccgccgaggacaggcggcugaagcgcacggcccggcgccgguacacccgccggcgcaacaggauccucuaccugcaggagaucuucagcgaggagaugggcaagguagacgacuccuucuuccaccgccuggaggacagcuuccuggugacggaggacaagcggggcgagcgccaccccauauucggaaaccuggaggaggaggucaaguaccacgagaacuuccccaccaucuaccaccuccggcaguaccuggccgacaaccccgagaagaccgaucuacgccugguguaccucgcccuggcgcacaucaucaaguucggagggcacuuccugaucgagggcaaguucgacacccggaacaacgacgugcagcgucucuuccaggaguuccuggccgucuacgacaauacguucgagaacuccagccugcaggagcagaacguccagguggaggagauccucaccgacaagaucucaaagagcgccaaaaaggaccgggugcugaagcuguucccgaacgagaaguccaacgggcgcuucgccgaguuccuaaagcugaucgugggcaaccaggcggacuucaagaagcacuucgagcuggaggagaaagcgccccuccaguucuccaaggacaucuacgaggaggagcuggaggugcugcucgcccaaaucggcgacaacuacgccgagcuguuccuguccgccaagaagcucuacgacagcauccugcuguccgggauccucaccgucaccgacgugagcacgaaggcgccccuguccgccagcaugauccagcgguacaacgagcaccagauggaccuggcccagcucaagcaguucauccgucagaagcuguccgacaaguacaacgagguguucagcgacgucagcaaggacggcuacgccggguacaucgacggcaagaccaaccaggaggccuucuacaaguaccugaagggccuccugaacaagaucgagggauccggcuacuuccuggacaagaucgagcgagaggacuuccuccgcaagcagcgcaccuucgacaacgggagcaucccccaucagauccaccuccaggagaugcgggccaucauccgccggcaggccgaguucuacccguuccuggccgacaaccaggaccgcaucgagaagauccugaccuuccggauccccuacuacgugggcccccuggcccgcgggaaauccgacuucgccuggcugagccggaaguccgcggacaagaucacgcccuggaacuucgacgagaucguggacaaggagagcuccgucgaggccuucaucaaccgcaugaccaacuacgaccuguaccucccgaaccagaaggugcugcccaagcacagccugcucuacgagaaauucaccguguacaacgagcugaccaaggucaaguacaagacggagcagggcaagaccgccuucuucgacgccaacaugaagcaggagaucuucgacggcguguucaaggucuaccggaaggugaccaaggacaagcugauggacuuccucgagaaggaguucgacgaguuccgcaucguggaccugaccgggcuggacaaggagaacaaggccuucaacgcguccuacggcaccuaccacgaccuccggaagauccuggacaaggacuuccuggacaacagcaagaacgagaagauccucgaggacaucguccugacccugacccucuucgaggaccgcgagaugauccggaagcgccugaagaacuacuccgaccugcucaccaaggagcagcugaagaaacuggagcggagacacuacacggguuggggccggcucagcgccgagcugauccacgggauccgcaacaaggagucccggaagaccauacuggacuaccucaucgacgacggcaacagcaaccgcaacuucaugcagcugaucaacgacgacgcccuguccuucaaggaagagaucgccaaggcccaggugaucggcgagaccgacaaccucaaccagguggucagcgauaucgccgggucccccgccaucaagaagggcauccugcagagccugaagaucguggacgagcucgugaagaucauggggcaucagcccgagaacaucgucguggagauggcgcgcgagaaccaguuuaccaaccaaggccggcgcaacucccaacagcggcugaaggggcugacggacagcaucaaggaguucggcagccagauccucaaggagcacccgguggagaacucccagcugcagaacgaccgccuguuccucuacuaccugcagaacggccgggacauguacaccggggaggagcuggacaucgacuaccucagccaguacgacaucgaccauaucaucccccaggccuucaucaaggacaacuccaucgacaaccguguccugaccagcuccaaggagaaccggggcaaaagcgacgacgugcccuccaagaacgugguccgcaagaugaaguccuacuggagcaagcugcucagcgcgaagcugaucacccagcggaaguucgacaaccugacgaaggccgagcgcgggggccucaccgacgacgacaaggccgguuucaucaagcggcagcugguggagacccgccagaucaccaagcacguggcccggauccuggacgagcguuuccacaccgagacggacgagaacaacaagaagauccggcaggucaagaucgugacccucaaguccaaccuggugagcaacuuccgcaaggaguucgagcuguacaagguccgggagaucaacgacuaccaccacgcccacgacgcguaccucaacgcggugaucgggaaggcccugcugggcguguacccccagcucgagccggaguucgucuacggcgacuacccccacuuucacggccacaaggagaacaaggccaccgccaagaaguucuucuacuccaacaucaugaacuucuucaagaaggacgacgugcgcaccgacaagaacggggagaucaucuggaagaaggacgagcacaucuccaacaucaagaaggugcuguccuacccccaggucaauaucgugaagaagguggaggaacaaacgggcgguuucagcaaggaguccauccugcccaagggcaacagcgacaagcucaucccacggaagaccaagaaguucuacugggacaccaagaaguacggcggguucgauagccccauugucgcguacuccauccuggugaucgccgauaucgagaagggcaagagcaagaagcugaagaccgugaaggcccucgucggggugacgaucauggagaagaugacauucgagcgcgaccccguggccuuccuggagcggaagggcuaccgcaacguccaggaggagaacaucaucaagcugcccaaguauucccucuucaagcuggagaacggccgcaagcggcugcucgcuagcgcccgcgagcugcagaaggggaacgagaucgugcugccuaaccaccucggcacccugcuguaccacgccaagaacauccacaagguggacgagcccaagcaccucgacuacgucgacaagcacaaggacgaguucaaggaacuucuggacguggugaguaacuucagcaagaaguacacccucgccgaggggaaccuggagaagaucaaagagcuguacgcccagaacaacggcgaggaccucaaggagcuggcguccagcuucaucaaccugcucacguucaccgccaucggggcccccgccaccuucaaguucuucgacaagaacauagaccggaagcgcuacaccuccacgaccgagaucuugaacgccacccugauccaccagagcaucaccggccucuacgagacgcggaucgaccuguccaagcugggcggggacuga

SEQ ID NO: 7640 - RNA, 4038 nt, Artificial Sequence; identical to SEQ ID NO: 1840
  Cas9 variant

SEQ ID NO: 7641 - RNA, 4038 nt, Artificial Sequence
  Cas9 variant
auggucgaaaaauacgguaucggacucgacaucggcacgagcacacucggcuggaccuccgucgacgaaaacggcaaaauacaaagacugaaaggucaaaccgcgcuugguacgcgacuuuucaacgagggacaaaccgccgaggaacguagaggcuuccgcacgacacgccgacgaauacagaggcgucgguggagacuacgccuacuccgagagaucuuugacgaaccaaucggcuccgucgacgcgggcuucuucgcccgacagaaaauguccagucugucuccacaggacgaccgauucgaagacacguacagacucuucaacaaucaaacagauaaggcuuuccacgacgaauaucccaccacguaccaucuccgccaagcucuaaugaacucagacagacaguucgacauacgcgaaaucuaccucgcaauacaccauaucguaaaauaccgcggcaacuuccuccgcucaggcaaaccugccgacuuuaaaacgggcaagcuagaucucaaggaaaaauucgaggagauaaacgccgauuggcagacccucaucuccgaggaugcaccucagcugccagucgaugaccucacgaccauuaaagcuguucucgucgacggcagccgaucgcgaucagaucgacaacgcggccuugucaaacuuuggauggccaaugaaaccguggagaaaaacuggaaacccgugaugacggaacucgccaaagcuauucucggccuuaaaaccaaacuguaccugcuaacaggacucgaucugccgaaggaagaccagaaagccuggacauuuagucuggacacauuagaagaccaccaaggcgacauagauagcuucuucgacgaucacgcccagcaacuaauugaucgccuagccgagcuacgcgccaugauccaacugaccgaaaucauaccaucagggcuaaacuucagccaaucaaugguucagcgcuacgaagcccaccgcucacaccuagaaauguacaagcaauaugcgcuagaccaaaccgaucccaagcgcaccaaagcccucagagcggccuacaacgccuacauagaccaacacgagauagcggaugacuucuacacggcaguaaaaagggucacgaaagacgaccaaucagagacggccgaagagauaaaccgccugauaggccucgaacaguucaugcccaagcagcgcacaaaggaaaauggcguuauccccuaccaaguccaucagcaagaacucgaccaaaucaucgcccaccagaaaaaguacuaccccuuccugggcaccgaaaaccccgucauagaccaccgggaaucccaacccuacaugcucgacgagcuagugagcuuccgcguacccuauuauguaggcccgauggucgcagcgaaccccgaacuaaaaaccacggaaaacccuuucgcguggaugauccgcaaagcacaaggugaaaucacaccguggaacuucgacgaaaaggucgaccgcaaaggaucugccaccgccuuuauagaacgcaugaagacuaccgacaccuaucuccucggagaagacguacuaccccaacaaucccuucucuaccaacgauucaugguccuuaacgagcuaaacaacauccggauagacgacgaacuccucacaaccaaucaaaaacaauggguauucgacagaguguucaaagguaaaggcaccaucuccgcgaaacaccuccaagaugcacuaaaacaccacggagaaaccgacggccuaccaaaaauauccggccuagccgaccccacaaaauuuaacucagcacugaccuccuaccgcgacuuccaaaaauggcugccaaacgacaucgauaggaaagaccgcacagcugacauugagacaaucaucaacuggagcacggucuuugaagacacucauauauucguggaaaaacuaaaagaaaucgaaugguugaccgcggaccaacgacgccgaaucgcguccaaucgauaccggggcuggggccgacuauccaaacaccuccugacggaaaucaaagaugagcaaggccuguccaucauggaccaacucuggcgaacgcagcacaacuucaugcaaaucguucacgaaccugacuacgccaaacaaauagaagccgcaaauaccgucggcauggcuaaacaagacauagguacugucauaaacgaccuguacacuagcccccaaaauaagaaggccauccggcagguucuagccgucgucaaagacauccaaaaugcucaccauggagucgcacccuccuggaucuucauggaagccgcucggggugcagaccagaacccacaaagaucccgccagcgacagagacagcugcaggaccucuaugcaaaaaccgccgccgaccucguggacaccgaagugcaacaggaacuaaccgacaaaauuaaagauaaggccaacuucaccgaccgacuaauguuauacuucuuacagaacggucaggauauguauagcaaggaaaagcuaaauauagaccgacuaagcgaauacgacauagaccacauccugccacaagcccuaaucaaagacgacagucucgacaaccgaguucuaguacaucaaagcaucaaccgaaauaaaagcgacaccuucgcauccgagaaauacggggccaaaaugcaaggcgccuggcaccaauggcgagcagccggacugaucuccgcaagaaaacuaagaaaccuagaaaugcgacccgacgaaauaaguaaauacgcaacgggcuucauacgacgucaacucguagagacucgacaagugaucaaacuggucaccgaaauacucucacaccaguacaacccggaagagacuaagcuaguuucagucaaagccggacuaagccacgaacuucgccgggaagcaggucucccaaaacucagagaucucaacgacuaucaccaugcaaucgacgccuacuuagccgcgagaaucggcacauaccuacugaaacgguacccaagacuagaacgguucuuugucuacggacaauuucagacgucccgccucgaccuccgccgcuucaacuucauacacgaccucguaaaaucgaagcagggagucaucgucgacuccgacaccggagaaauccucugggauagacaaaaagauauagauuacauuaaacaccuuaugggccuaaaacaccuacuggugacacacgaaguguacgacuccgccgccgagauguacgcacagacaaucuucaaagcgucagacaacgacucgaaaguccuaaucccuaccaagaacgacagaccgacagccaucuacgggggcuacaccaaacgccgcaacgguuacuuagccauccucaaaaucacagagaaaaaggccgagaccuaccgcguagucggaguccccacccuauacaugucacagcuggccacugcccgcucccacucugucgaagccgaaaaagcauuacuaaaaucacuaauggcaccagaaauauuaucggaaucgaaaguaguuuccuucgaagucguggucagccacguccaccucaaccagcuaguccgagacaccguguucggaccagcgcacuacuucggacucggcccauucagauacguucgcaacuuccaccaacucguacuacccuucaaagaccaggaaauccucgucaaacgcaccccuacagacgaggaacucaacaccguguuugaagacauaugcuggcaaguagaaaacuacuuugccguuuucgacauuaacggguucagaaaugcccucaaaaagucaauagacaaauucgaacagcuaccaaucgagaacguuuucaaagacaagaaauuggucacccaagguaagaaagaggugcuggcguucguuaugcaggggcuccacgccaacgccagcuaccggaaccugaaaguaucacucggcauaaaaacuccacuaggacaacuacagcucacuaaauuuaugcucucccgugacgccgagcucaucgacgaaucgccaaccgguuuauucagaagaauccgacgccuaaaagaccucuga

SEQ ID NO: 7642 - RNA, 4038 nt, Artificial Sequence
  Cas9 variant
augggcaacaagcugcgcaacguggacgauuacuaccucgggcuggacauaggcaccgagagcguggggugggccgugaccgacaaguacuacgugauuccgaaauucaagggcaacgccauguggggcguacaucuguucgacgagggagagacguccgugaagcggcgaggcuuccggagcgcgcgccggcgcacccagcggaagcgcgagcggcuggcccugcuggaggcccucuucgacgaggagaucugcaagaaggauugcaccuucuuccgccggcugcacgaguccgaccuguggccggaggacaagucuggggacgacaaguacgccguguucgccgacgagaacuacacggacaaggacuuccacaaggaguacccaacgaucuaucaccuccgcuacgagcugaucaagaacaaggagccccacgacgucaagcugguguuccucgcgcugcaccacaucaucaagaaccggggccacuuccuuuucgacucccucagcuccgccgaggacuucaacucggccuacgagaccaugugcuccuaccuuagcgacaaugagauccagcugaacugcuccgacaucgagcaguucaaggccauccugaaggaccgccggcaggggaagauagagaaaaccaagaaccuagcgagccuguucggcauaaccaagaaguccgaccccgugagcuacgccguuauggccgugcucuccgggagcacggugaagaugugcgaccuguuuggcgacgacgaacugaagacugucgagaagaacaacaucucauucgccagcggcuacgaggagaacgaggagaucuacgccuccgugcucggagaccgcuucgagcuggugaagauccugaaggcggucuacgacugggcagugcucgcagacauccuggacgggaaaaaguauauaucggaggccaaaguggccgucuacgaaaaacacaagaacgaccugaagacccucaagaaguacgugaagaccuaccugccggagaaguacaacgagaucuucaagauaagcgacgggaagaaggacaacuacguggcguacuccggccacaucaaggagagcggcaagaccggggaacugaagaagaccugcaacuccgagaacuucugcgccuaccuuaagaagacccucggcaagaaugccgaccugagcuacaaggagauguucgacgagaucgagaacaagaccuucaugcccaagcaggucacgaaguccaacggcguggugcccaugcaggucaacgaggaggagcucaaggccauccuggacaacgccaaggacuaccugagcuuucucaacuccugcgacgagaacggcgugagcgucuacgacaagaucaucaagaucuucgaguaccggauccccuacuacguggggccgcugaacacacacaccgaaaacuccuggcugaagcgcaaggacggcguuaagaucuaccccuggaacuucgacgacgucguggacaucgacagcucagcggagaaguuuaucaacaaccucaccagcaagugcacguaccugcccgagugcgacgucauccccaaaugcucgcugcucuacagcaaauucacugugcucaacgagaucaauaaucugaagcucaacggcgaggacaucccgguugagcugaagcaggguaucuacaaggaccuguucaugacgcggcgcaaggugaccgucaagcagauaaaggacuaccugaaggcccggggcugcuacgacaacaacgacgugcucuccgggaucgacacgaccgucaagagcucccucaagagcuacuucgauuucaagggcuucgagucccugaccuucgacgacaaggagagcaucauagcgagcuccguaaucuucggggacgacaagaaacuccugaagaagaggcugaagaaacuguuccccgagaagcugacugacgaggacaucaaaaagaucuguaagcugaaguacacgggcuggagccgucucuccaaggaguuccugugcgacguggaguucaccuacaagaagaccggcgaggugaugaacgucaucaccgcccugugggagacgaacuacaaccucaugcagauccuguacuccgaagacuucugcugcgacggggacgagaagaagaaccugaacgauaagcucgacgagcugucauacaccggcgaccagcacagccugcggaaggccguggacgcgcuauacgugucccccaagguaaagcgccccauccugcgagcccugcucaucgccaaggagaucgagaagauccaagagcgcccgcccaagaagaucuucguugagguggcucgggggaucgauaaucgcgaggagaggcaccgcgauucacggaaaaaccgccugauggagcuguacaagaacugcaagaaggaagcggagaaauucugccccuacuucgaugcccucuccaagaagcugagcgacgaggacgaguccaagcugcggcgcgacaagcucuacuucuauuacauccagcugggcaaaugcauguacaccggggaggagauuagccugggagagcucaugaacggcaacggucgguuugacaucgaccacaucuacccccgcucgaagaucaaggacgacucgcucaccaacaagguccuggugaacaagacggugaacaacaacaagaccaacgucuacccgaucgacgccgccauccaguccaagaugagcccuuacuggcagaugcuccgguccagcggccugaucagcgaggagaccuacaagagacugacccggaagacgccccucaccgacgacgagcuguccgccuucguuagucgccagcugaccgagacccagcaguccaccaaggcgguggcgcacauccucgagcagcuguaucccaagccgaagacggagaucgucuacgugaaggccgcccuggugcacgccuuccgucagagcaacgacaugcucaagugccgcgaggucaacgaccugcaccaugcgaaagacgccuaccugaacaucgugguggggaacgccuacaacgucaaggugacccacaauaaggugaacuucauaaagggccuccagaacaacgacaagggcuauacagucaaccccgagaaguuuuucucccacgacauacccggggccuggagcgugaaggacuccaugaacaccgugcgcagguucaugaacaaaaacaacauccgcuacacgcgguuccccagaaagaagcagggcgggcuguucaagaucaacccgcugaaaaagggcaacgggcaggucccccucaaggccucgggagcgcgguccugcaucgagaaguacggcggguacgacaaggccaccagcgccuacuucuccuauguggaauacacugacaagaagggcaaggccguucgccagauguuccccguuaaccuguacgaggugaaagaauacgaggcggacaugcagggguucgugaccagccggaucgccgaggccuccaacgucaaaauccugaucccgugcgugaaguacgacgccugcaucagcuucgacggcugcagaauguucaucacgaagaagaccggaaaccggaucggcuacaagccgggcaugcagcucguguugggguacaaguacgagaaguacauccgcaacaucgagaacuaccugaccaagcacaaagacagggaaaucaucccccgcgauaacaucucggccgaggagaacaucgagcucuacgacauccugaccggcaagaugcugaacacgguccucuccgugaaguucuccgggauuggcaagaagcuggagaagagacgcgagaaguucgugcugugcagccccgaggagcagugcugcguccucaaugagauccugaaaauucugcacgcgaacgugcucuccggggaccugucacugauaggcgaaagcccgaacaccggcaccaugaagaccaacgcgaaguucuccgaaaucaaggacguccacagcaucaagcucaucaaccagagugugacgggccuguucgagcaagagaucgaccugcucaaguga

SEQ ID NO: 7643 - RNA, 4038 nt, Artificial Sequence
  Cas9 variant
augggaaagcccuacucaauugggcuggacaucggcaccaacuccgugggcugggccgucgugaccgacgacuauaaggugccggcuaagaagaugaaaguccucggaaacacggacaagcagagcaucaagaaaaaccugcugggggcgcuccuguucgacucaggcgagaccgccgaggccacccgccucaagcggaccgcccgccggagguacacgcggcgcaagaaccggcuccgcuaccugcaggagauuuucaccggcgagaugaacaaggucgacgagaacuucuuccagcgguuagacgacagcuuucucguggacgaggacaagcgcggggagcaccacccuaucuucggaaacaucgcggcggaggucaaguaccacgacgacuuccccacaaucuaucaccuccggcgccaccuggccgacaccuccaagaaggccgaccugcggcugguguaccuggcccuagcgcacaugaucaaguuucgcggacacuuccuguacgagggcgacuuaaaggccgagaacacggauguucaggcccuguucaaggacuucgucgaggaguacgauaagaccaucgaggagucccaucuguccgagaucacuguggacgcccugagcaucuuaaccgagaaggucuccaagagcucccggcuggagaaccugaucgcucacuacccgacggagaagaagaacacccucuucgggaaucugaucgcgcugagccucgacuugcacccgaauuucaagaccaacuuccaacugucagaggacgccaagcuccaguucagcaaggacaccuacgaggaagaccuggagggcuuccugggcgaggugggcgacgaguacgcugaccucuucgccuccgccaagaaccucuacgacgcuauacugcucagcggcauacugacgguggacgacaauuccaccaaggccccgcugagcgccucgauggugaagcguuacgaggagcaccagaaggaccucaagaagcugaaggacuuuaucaaggucaacgcccccgaucaguacaacgccaucuucaaggacaagaacaagaaggguuacgcgagcuacaucgagagcggcgugaagcaggacgaguucuacaaguaucugaaggggauccucuuaaagaucaacggguccggcgacuuccucgacaaaaucgaccgggaggacuuccuacgcaagcagcgcaccuucgacaacgggucgauuccacaccagauccaccuccaggagaugcacgcuauccugcgccggcagggcgagcacuacccguuccugaaggagaaccaggacaagaucgagaaaauccugaccuuccgaauccccuacuacguggggccccuggcccgcaagggcucccgguucgccugggcugaguacaaagcggacgagaaaaucacgcccuggaauuucgaugacaucuuggacaaggagaaguccgccgagaaguucaucacccgcaugacccucaacgaccuguaucugccggaggagaagguccuccccaagcacagcccccuguacgaggccuucacggucuauaaugagcugacgaaggugaaguacguuaacgaacagggcgaggccaaguucuucgacacgaacaugaagcaggagaucuucgaccacgucuuuaaagagaaccggaaggugaccaaagacaagcuccugaacuaccugaacaaagaguucgaagaguuccgcaucgucaaccucaccgggcuggacaaggaaaacaaggcuuuuaacuccucccugggcacguaccacgaccuccggaaaauccuggacaagagcuuccuggacgacaaagccaacgagaagaccaucgaggacaucauucaaacccucaccuuguucgaagaccgcgagaugauccggcagagacugcagaaauacuccgacaucuucacgaaggcccagcucaagaagcuggagcggcgccacuacaccggcuggggccggcugagcuacaagcucauaaacggcauucgcaacaaggagaacaagaagacuauccuggacuaccugaucgacgacggauacgcgaaucggaacuucaugcagcuaauuaacgacgacgcccuuuccuuuaaggaggagaucgcgcgcgcucaaaucaucgacgacguugaugacaucgccaacgucgugcacgaccugcccggcucaccggcuauaaagaaggggauccuccaguccgugaagaucgucgacgaacuggugaaggugaugggccacaaccccgcuaacaucaucauagaaauggcgcgggagaaccagaccacggacaaggggcgcagaaacagccaacagcggcugaagcuccugcaagacucccugaagaaccucgacaaccccgucaacaucaagaacguggagaaccaacagcuacagaacgaccggcuauuccucuacuacauccagaacggcaaggacauguacaccggggaaacccuagacaucaacaaccugagccaauacgauaucgaccacauuaucccccaggcauucaucaaggacaacucccucgacaaccgagugcugacccgcagugacaagaaccggggcaaaucugacgacgugccaagcaucgagguggugcacgagaugaaguccuucuggagcaagcugcuauccgugaagcugaucacccagcgcaaguucgacaaccugacgaaggccgaacggggcgggcucaccgaggaggacaaggccggauucaucaaacgccaacugguggaaacccggcagaucaccaagcacguggcccagauccuggaugagcgcuucaacacggaguucgacgggaacaagcggcgcauuaggaacguuaagaucaucacucucaagucuaaccugguaagcaacuuccgcaaggaguucgagcucuacaaggugcgcgagaucaacgacuaccaccacgcacacgacgccuaccuaaacgcugucgugggcaacgcucuccugcucaaguacccccagcuggagcccgaguucgucuacggcgaguaucccaaguacaacuccuaccgcagccggaaguccgcuacggagaaguuccuguucuacagcaacauccuccgcuucuucaaaaaggaggacauccagaccaacgaggacggggagaucgccuggaacaaagagaagcacaucaagauccugcggaaaguccuguccuacccccaggugaacaucgugaagaagacggaggagcaaaccggcggguucagcaaggaguccauacuccccaagggcgaaagcgauaagcugaucccccgcaagacgaagaacaguuacugggaccccaagaaauacgggggcuucgacagcccggucguggcauacuccauucuuguguucgccgacgucgaaaagggcaagagcaagaaacuccggaaggugcaagacaugguggguauaaccaucauggagaagaaacgcuucgagaaaaaccccgucgacuuccuggagcagcggggcuaccgcaaugugcggcuggagaagauuaucaagcuccccaaguauucccuguucgagcuggagaacaagcgccgacggcuccuggccagcgcgaaagagcugcagaaggggaacgaacucgugaucccgcagagauucacgacccugcuguaccacagcuaccguaucgagaaggacuacgagcccgagcaccgagaguaugucgagaaacacaaggacgaguucaaggagcuccuggaguacauauccguguucagccggaaauacgugcuggcggacaacaaccucaccaagaucgagaugcuguucucaaagaauaaagacgccgaggucagcucccuggccaagagcuucaucucccuccugaccuucacggcauucggcgccccagccgccuucaauuucuucggugagaacaucgacaggaagcgguacaccuccgugaccgagugccugaacgccacccucauccaccaguccaucacgggccuguacgagacccgcaucgaccugagcaagcucggugaggacuga

SEQ ID NO: 7644 - RNA, 4038 nt, Artificial Sequence; identical to SEQ ID NO: 1844
  Cas9 variant

SEQ ID NO: 7645 - RNA, 4038 nt, Artificial Sequence; identical to SEQ ID NO: 1845
  Cas9 variant

SEQ ID NO: 7646 - RNA, 4041 nt, Artificial Sequence; identical to SEQ ID NO: 1846
  Cas9 variant

SEQ ID NO: 7647 - RNA, 4041 nt, Artificial Sequence
  Cas9 variant
augcugagcgccggcgugaugcucggagacgucagcgcccucaagagcucccgcaacagccuguuccagaaguccaagaagcugaucgagaacagcaguagcgaccugaccaagguggacuacuccaagaugcgggagauccuucucagcauccgcaacaucgcgauccgguucuucaacaacgaggacuucaaggaguccgacuacuacaaggaguuccccaccaucuggcaccuccgcaaaaacuuaauggagagcgacaagaaggccgacauccggcugguguaccuagcccugcacaacaucgucaaauaccgcggcaacuuccuccaggagaacaacaaggaccugcgggccgccaacgcgaacgccggggccgccgcgauagaccuguccaaugcccucgaggaguacuucucucugcacgaggacgaguccgcccugacgugcgugccgaacguggcugaccuccagaugacccuggagcagcccggccugcgcaacggggagcggcucgaccgcaucgucgccgcgcugaacaugccagaccgggcccgcgccaagcuguucgccaaggccugcauuggccagaagguggaguucagcaagcucgcgcugggcauggagaagcaggaggggaccaacgccuacaucugggacgacgacaaguacgacgagcugguggcccucugccccgaggacuucuucccgguccuggagacccugaagaacgccuacuccgccuaugugcucagcgaccugcuggcgggcaagcucuccaucagcgcuagccugaucgacuccuacgagcagcaccagaaugaccugaagaucgugaaggagcucguccgggaguaccugggccagaaggaguacggccgccuguuccgggggcccaaguucgccaacggcgacuacaacuucaacaagguggccaagcccagcuacacguccuacauccucggcgagagccugugcaacaagcaggggaccaccagagaggagcuggugaaggagcucaagcgggucuucgacgacugcuccgccauccaggcggacaagagguaccagaagaucaagcagcggcuggaggacgaccccaaguuccugaucaagcagaagacccgcgccaacggcgccaucccguaccagcuccacuuggaggagaugcaccagaucauugagaagcaggggaaguacuaccccuuccugguagagcagcaggaccucaucgagaagcuggugagcucccggauccccuacuacguuggcccccugaacggcgggcacgacccgaaccaccccuaccccacgaaccccauagacccgaaaaggaaguucgccuggagcgugcgcaagcccggcauggagcacgagaaggcguaccccuggaacguggaugaggucaucgacuccgaggagaccgccgagcgguucauccgccggaugaccgggaccugcacguaccuguacggcgagcccguggugccgcgcugcagccuccuguacgaggaguucugcguccugaacgagcucaacggggcccgguggggcgagggcaacggggacacccaccgcuuugacuccagcgaccggacagagauccuggagcaacuguucaagaagcgcaagcgggugacgcauaaggccaucgccacguggcuagagaucaaccacggcgucaccaacgugaagaucuccgggacccaggcggagaacgccuucgagagcaagcucuccagcuacaacgacuucugcaaccugcucggcgucgacgggcuggaggacgucugcccccugaccaaggacgacaucgaacagaucauucucugggugaccguguucgaggacaagaagcugcugcuccagaagcugcagcgcgccuucggcgacaagcuguccgagaagcagaucgcaagcaucaugcggaagcccuacgccggcugggggcgccucuccagcaagcugcugaccggcaucaagcgggagacccccuucgggcgcauuagcauccucgacgucaugcgggacggcgauccgcgccccgggcaccaccuggacgcgaugaacuucauggagauccugcgggagaaggacuucggcuuccaggaccgcaucgacgagaucaacaaggagcggaccaaggaguccggccuccugcugagcguggaggaccuccccgggucccccgcccugcgccgcagcgugaaccaggccaugcacauucugaaggagaucgucuccaucgccggcaaggagccgagccggaucgugaucgaggugacgcgcgaccccgacgaggagaaacgggggcaccgcaccgacacccgguacaagcagcucucugaggcccuggcggccaucaagaccgacaucguccaguucgacagcucccugcucgccgagcugaaggagcgcaaggacagccuggacuccgagcggcucauguuauacuuccagcagugcggcaagagccucuacuccggcaagccccucgacauaaaucgccugagcgaguaccaggucgaccacaucaucccgcagugcuacaucaaggacgacucccuggacaacaaggcccucguguucgcgagcgagaaccagauuaagcuggauucccugcuccuggacaagagcaucauccggagccagaaggggcgcuggcaggagcugcaccgggccggccucaucuccaacaagaaguuccgcaaccuaacgugcaccgagaucagcgaccggaugaugaagggguucaucaaccgccagcuggucgagaccucccagaucgugaaguucgugcggcagaugugcgagcagcgcuacgagagcuccgaggucaucagccuccgggccucccugagccacaaccugcgcgaccggugcggcuucaucaagugccgcgagcucaaugacuaccaccacgcccacgaugccuaccuggcgugccagaucgcccgguucaucgggauccgcuacccccgcuggcaggacggcaucucccgggaguucaucaacaaguacaucaaacagcuggugaagaaggggaaaagcuccgggaaguucuucgccggcaagagcggguuuaucaucgacuccuuuaugcacgacggcuucgaccgcgagaccggggagaucuuccgggauggcugggacgccacguucgagaucacccgcaugcggcgcgugcucggcuacaaggacugcuuuauaacccggaugcccgaggagcagaccggggccuacugggaggagacgaucuacagcccccuggacgcgaagaacggcaagaaccugcagaucccgcucaagcaguccgggaaggagggcuaccuggaccccaagaaguacgggggcaccaacacagccuucaacgccuacuucuucgccuucgucgccaaggacgcgcgcggccgggacaaguacuucuucgagggggugcccguguaccuggccaagcagcucaaugagcagccccagauccuggucgacuucgccaacagcaucgccgcgacaaagaagugcuccaccgccaagauccugcgcagcaaggugccgcuccggcagaaguuccugcuggacggcacguccuucuaccucgggggccgcaccgggaacaagaacgugauccugagcggcgucgaguucgccugcggcaucgacauggccaagaugaucgacacugccaucaagcaccccgaggaacugagccagaaggagcucaucagcauuauccagaugcuggcggacaccaucgagcggaacagcgaccgccaggccucccugaucaacuuccggcgcuucgacgacaagcuccggaacaucgacgccaucgcggccagccgcaucaucaagaaccugcugaacuccaugaacggagugaagcagagcugcgaccucuccgaccugggcgggucuaagcaguccggcuucaugcagagcaacaucgcgacguuguucgagcggaucaccuggugcuacuccagcaucaccggcauguucgagcagcgcguguccuucgaggaccucaagaacgggaucuga

SEQ ID NO: 7648 - RNA, 4041 nt, Artificial Sequence
  Cas9 variant
augaagaagcgcaaccgggaagaguacuacguaggccuagacaucgggaccagcagugucggcugggccguggcgacccccgacuaccgcaucccgaaguuccgggggcacaagauguggggcagccgccucuucgcggaagguaagcgugccgccgagcgccggcaguuucgcacgaaccggcgccggcuggcccgccggcgcgaccggcugcagauauuagaggagcuguucgccgaggagauggcgaagguggacaacaccuuuuucaugcgcuuaaaagaauccaaauucuuccucgaggacaagaccguaaaggaaaagcacauacucuucagcaccgacaaguucgacgccgaccgguucuacaaggacaaccccacgaucuaccacgugcgcaagcggcugauggaggaggagccccaggacauccgcgagcuguuccucgccgugcaccacaucuugaaguaccggggccacuuccucuucgcuggcucucuggagcaaaacggggacagcaucgaggagcucguccgcacccucuucggcaagcagggguuggcgauccuggacgacaccaucgacuccaaugagauggugaacauccucaagaacaacgagaagaccaagucagaccgcaagaaggccgugcaggaguuguggaauccgcugaaggacaaggucaagaaggcccaggccgccgagauggcgggcgugguguuaggcuugaacuccgacaucagcaaacuguuugacaacuccgauuacaaggaucucaagaucaacuucagcuccggcgacuacgacgagaagcgagacgacuacgccaacucgaucggugacgauauaguccuguuagacacuaugaaagcccucuacgacacccugauccugagccagauccuccaggggaagcaaagcaucuccgaggccaagguggaggacuacaacacccacaaagagcaacugcgcgcccugaaggcgauucucaagccacacaagcggcuguacaacgagauguuccgcgagaauaacaagaaggaccugagcaauuacguggccuacaucuccagcuacagcgaggguaagagggucaaccgagagggguucuacaaguacguacaggccgugcugaaacaggucgacgacucugacagcaagcaggccauccuggaggccauccggcuggagaccuucuuacccuugcugcgcgucaaggacaaugccgugauaccccaccagauccaccaggccgagcuggaggccaucuuagagacggcccggaagaaguacaaguuccugaacgacgucuccgaaggcgugagcgugaaagacaaaaucauccagcuguucaccuuccguauccccuauuacgucggcccgcucaacccccauuccggggagaccguggccgaccggaagcagggcaccgggugggucgugcgcaagcagcgagguaagguguauccuuggaauuucgcggacauggucgacgucaaggccucagccgaggccuucaucacgaaccugaccaacaagugcaccuaccucaucggggaggacgugcuucccaagaggucccugcuguacagcgaguucaugcuacugaacgaguugaacaugaucaaauacgacggccacgaacucccggucgaaaucaagcgacuuuacaucgagcaggucuuuaagcaggaacacaagaagcagaccaagggcagagugcuggauuuccucaagcggaacgggcugaucacaggcuccgcuaccgccgugaucacggggauggacgacagcauaaagggcgaccugcaauccuaccgcgacauggugcggaucuucgggaccggcuucgaccacagcauggccgagcgaaucaucagaugggugacccucuucggcgaggccaaggacauccuggaaaacaagauccgggaggucuacggcaacuccauaagcgacucgcagaugagggccaucaagaaacuuaaguacgcggacuggggccggcugagccaggccuucuucaucaagaucaucgggugcgacaaguccggcguggagcgcaacaucauaacgugccugcgggagagcagucagaaccugauggaaauccucagcgaccagggaaccuacaucaagcagaucaaggccuggaaccaccagcacacaacaaauaugauggacacacuggacuaccagcugguggacgaccucuacgucgccccaucggugaagagguccaucuggcaaagccugugcaucguugaggagcugguaaagauaaugggccaggcccccaagaagaucuucguggaggugacccgcacuaaucaggcagagaagacgaagaaggacucccgcaagaagcgccucgucgagcuguacaccgcgaucgguaaggagggggccgccuggaagaaggaaaucgagaagcaccaggccggcgacuuccgcagaaagaaauuguaccucuacuauacccagaugggacgcugcauguacagucacgagcccaucgccauggacgcucuguucacguccgaguacgacaucgaccacaucuauccgcagagccugacgaaagacgauuccugggacaaccucgugcuggucaagagccagcugaacaaggagaagucugaccaguacccucuccggcccgccauccgcgagaagaacaaggccuacuggcaguaccucugccgggcgggcuucaucucagaaaagaaguacgagcgccugaugcggaccaccgagcucaccgccgaggagcuguccggguucaucgcccgccaacugguggagaccucgcaggccacgaaggccgugaucggguuacuggagcggaucuacaagcauaccgauaucugcuucgugaaggcggagacggucucccaguuucgccaccagcacaacuucaucaagauccgcgagcugaacaacuaccaccacgccaaggaugccuaccucaacaucgugguuggcaacgucuaccacgagaaguucaccaagaauccccgcgaguucaucgcucgcagcacagaacggcgcccguacaaccuaaaccggauguacgacuucgaucugcucaagcaggggcgcgugaucuggcaagugcccaagucccuggagaccgugcaggccaugaugaaguccaacgacgugcggaucacgaagaaacugcuggugcagaagggcgagcuguacgacgcuaccauaacgaaggcgcacaagacaaaggaggggauguacuucccccugaagggcgccgacgcccgccuccgggacguccaccgcuacggcggguacgaaaagaucaagaucgccuacuacagcguguucagcugcugcgagaaggcgagcgacaccauccacacccugaucauccccaucccgguguacgccgccggccuauuacagacagaggccgaccugaccgcguacgccuggcagaccaagcagaagaccaagccgaucaaggacauuuacuccaugauuacgcccaucuacaagaagcugugcaucaacaccgucgugaagaucgacggguuuaaguacuucuugggcgggcggaccgaagacuacaucugccuguacccagcuaucccggugguccuggacgagcaggcugccgcguaccucaaggccgucagcaaggugggccgcgccgaugaugucgagaacaccgcccaggcuaucgaccucaucacggcugaggccaacgaggccuucuacgacgugcuucucaagaagauggaggccaagaucuucgucaaggccuaccaggagcgggucgaaaagcuggcguccgagacggcccgcgaacgguuucgcaaacugagcauaggugcccaguguuccugccuccuugaaaucuugaacuuacuggccaacaacaaaaccaccagcaacuugaagaaguggcugggggugacgaugucccggcgcaagcagcccauggaucugaccaagcuggaggagugcaucguguacgagaccucuaucaccggccucuacgagaaggccgucucccugcuguga

SEQ ID NO: 7649 - RNA, 4041 nt, Artificial Sequence
  Cas9 variant
augguagagcacuacgccauaggcuucgacauuggcaccgguucaacaggcuucgccggugucgauccaaacggaaaacucguccgcaugcgaggcaaaaacguguacggaguguaccgauucaagggaggcgaagcugccgcagacagacgcggauuuagaaccacacgccgccgcauaaaacgccgcaaauggcggcuccgauuccuuaaauccuucuuugaacccuacauagccccaaucgacccagaauuuuuccuacgccaaaaauacucggccgacagcccccuugauccgaaaggaauccgcgccgacaagggccucuuaagcgacaugagugaccaagaauuucacgcaaaguaccccacuaucuaucaccucagauaccaacuaaugcacgagaagaggcaauucgacgucagagagaucuacuuggccaugcaccacaucaucaaauaccgaggacacuuccucaucgaagacggcgcggacaacuucgacgcaaagcaaauagacuuuuucgaccaguuccaacgaauggccgcagucacagccgggcuuccggaacucgagacccucguagucccagacgaaacgcaauccgacgccuucaaacgaguacuguucgaugaaagccaaacuaaauccgacagacaaaaaguacuggcaucucaacugcuagacauacaagacaaccagucaaaagcaauaaaagacuuuauagcagcucucaccaaggcuguagucgggaugaaagccaaccuugccacccuuacaucgaccgcaaucgaauccaccgacaaaaacgauuggacaaagccucucggccagcucgacgacuuuuugcucaaacacgaggaagaccuagacgaagaugguuacgcguugaucgacgccgcgaaccagauguacuccgccgccguccuugcugcccuagugccagaaggcaugggcuucucggaagcaaugauggcaagauacgcacaacacaagaaacaacuagcacuauacaaacagguuaucgccagucuaccagauaaaacccaacgacacgaacucaaagacgcuuacgcagacuacauagaacacgcagcccagaacccacgagacgccuucuacaaacguguaaccaaaguacuggaaggaguagacucagcggacgcacgcaccgucaugaccgcaaucucccacgacgaguuccuacucaaacagcgaacucucuccaacgggaaaauaccauaccaaaugcaacagcacgaguucgacgcaaucaucgaaaaucagaaagccuacuaccccuggcucgcaacaccaaacccggucgaagccgacgccaagcgucucccauauuaccucgacgaacuaaucggauuccgcguacccuacuacgucggccccauggucacugaaaagcagagucaauuugcguggaugauccgcaaagcagacggcgaacucaccccauggaacuucuucgauguagucgauagggagaaaacagcaaaccgcuuuauccagcgaaugcaaaccaccgauaaauauauccucggagaagacguucucccaaaacauuccauacuauaucagcaguucgaaguccucaacgaauugaauaacauacgggucgaaaagcacccccugacaaccgaacagaagcaauucaucuaccaaagacuauucguugaccagcaaagaaagacuauaaccaagaagaaucuccaggacacgcucguagcgaugggcgaauuugacaaagcacccgacauagguggcuuagccaaagaagacgucaugaugucaucacuggcgacauuugccgacuacagcaaaauucucccagaagcaauauccgauccuacacggcagaaugacaucgaagacauaauagccuggaguacuauauucgaagacacgcaaaucuucuucgacaaguuaaaaacagucgacuggcucacuacccaacaaagaaaacggcucgcuagcauccgcuauaccggcugggggaaacuguccaagcgccuacuacagcaaauaccaacuagcaaacauacaaacguaauggcggcguuaugggcgacaucagacaacuucaugcagauacuucaggacgaacaguuucaggaaggcuuauacgacgcaaaucgccuccccgaagaaacacucacacccgacgaacaagucgagaaaauacucgacgaagccuaccugagcccagcagacaagaaaggagcgcguaaaguaauaaaagucaugaacgauauagugcgcgccaaccacggcguccugccagaacaagucuuccuagaaucggccgaugacccacagaaaaacaagcgccgaagcgucucccgauccaaacaacucgaagaaaaguaccgacaggccgcacaaucauucaucgaugaagcggucaaagaagaguugaacgcccaaaucgugaacuccgccgaguucaacgaucgccuaguccucuacuucacccagaacgggcgagacauguacacaggaaagcgucuagacaucgaaaaucugggcuccuaccagauagaccacauccugccgcaaagccuagucaaagaugacagccucgacaaucgcgccuuaaccgcacgcgacauaaacgcugagaugucaaaccaguucguauccgaacgauuuggucucggcccacgcgcauuuuggcaacaacugaagaacaacggccuaauauccggccggaaauuccguaaccuagugaugcagcgagacgaaauagacaaauaugccccgggcuucauaaacagacaauuaguagaaacaaggcaaauaauuaagaccguggaacaaauaauacaccggcuguggcccgacauacaaauaguuacuauaaaagcaaaccucacccaccaaguccgcagcgaacucggauuccccaaaguccgagaacuaaacgacuaucaccacgcauucgaugcauuacucgcagcccgaauagggcaguaccuucucgagcacuacgcaggcuugaaaccguucuuuaccuauggagaguucaagcgcggcgacacgaagaaguauggaacaacaaacuuccuccgccggcucacaaaagauaacaaggacaagaaaggcgaacuacuccccgaagucucagacuggauagacuccauugacucaaucuacaacuacaaaaagauaccagucguaugggaaaacacgaccaacaugucggcccuauucgaccaaaccaucuacccuagacccgaccgagacaccacaaaacgcaaacugauccccacaaaacucgacaaacccaccgauaucuaugguggcuauuccucagccaagaccgccuacauggcagucaugcgcguccaaacgaagaaaggcaccgaguacccaguauucaauauaccggucuccaucgccucccagcuuaaccgcaucaccgaccaaacgaugcucaaacaacaagucaaacaauucauuaucaacgccgaacaauccgccuccaagaagaaacucuacgagagcggagacguaauucucucccgcguagcccuugggcaacgguucacggauaaaaacuacggcgaaguuuuccuaauaaguaacauggagguccagaacccacaaucccucuggcucgggcgagcuagccagcaaagacuaacccgcgaaccagaagggaacgaaaaacccgaaaccucucucgcagacauauaccagcaaauccugaaacaagucgacagauacuucuuagcguucaacauccgccaacaacgacaaaaacuacucggcacccucgaccaauucaccucacuacccgucggccgagugaacgaacagacccggacugaucaaaaucaaagguccaucauagcucgugucaugauagugcugggcaaaggaucccgagaagaaaaguucccagaguucggacuguccgcccucggccgccugguccgaacgggagguaucacccucagcgaagacgcacagauaaucuaccaguccccaacaggccuuuucgaaaggcguguggcucucaaagaccuuuga

SEQ ID NO: 7650 - RNA, 4041 nt, Artificial Sequence
  Cas9 variant
auggccaagauccugggccucgaccuggggaccaacagcaucggcugggccguggucgacaucgagaacaacaacgaguucacccugaucgagaaggggguacgcaucuuccaggagggcgugaagauugagaaggggaucgagggcucgaaggcggccgagcggacgaccuacaggagcgcccggcgcaucaaguaccggcgcaagcuccggaagauccagcuacuggggguccucuccgagaacggguacugccccuuccugagcaaggacgagcuggacucguggcgcuacaagaagguguacccgaccaacaagagcuuccucaacuggcagaagaccaacgagauccagcuggagaaccccuacuucuaccgggcccugcucguggagaagaagcugaaccugaacauugaggaggaccgcuucaagaucggccgggcguucuaccaccucgcgcagcgccggggguuccuguccaaccgcauggagggcacgaaggagaacgacgggaccgucaucaagagcaucacggagaucuccaccgccaagggcgauaagacgcugggccaguacuucuacgagcgguacaagaagggggagaagauccgcgauaccuacacccacagggaggagcacuaccucgaggaguucgugcgcaucugcgaguuccagcagcuggacaacaaguucgccgagaaagugcggaaggccaucuucuaccagcgcccccucaagagccagaagggccucaucgggaagugcgucuucgagcccaagaagucccggugcagcgugucccgcccggaguucgaggaguaccgcaugcugugcuuccugaacaacaucaagaucaagacccccagcgacgagaaccuccgguuccugacggacaacgagaaggagaagcugaagccucaguucuuccgcaaguccaaggaccauuucgacuucgaggaccucgugaagcagcuggcgccaaagaaccaguucaaguucuauaagagccgggacauccugccgggcaacuggcuguucaacuacuccaugaacaccaccgucagcggcugccccaucuccgcccgccugaaggaccuguucggggagaacuucauggacaucaaguucgacuacauccgggagaaggacggcaagaaguccgugaucgacauccacgacaucuggcacguccucuucaccuacgacagcgaggagaagcugaaggaguucgcccggaaccggcugaaccucgacgacaucaagauuaaggaguuccagcgcauccagcugaagaaagaguacgccgcccugagccucaaggcgauccggaagauccugcccuuccugcgcgaggggcucaucuacagccacgcaguguucaucgccaacauggagacggccauccccuccgagaucuggaacaacuacaccaaccggaacaucaucaagaacgagaucuacaacaucaucagcaaccagaccgaggacaagcaggucguggacaucgugaacggcauaaucaaguccagccgcaucgagaacuccguauggagcaacgaggccguggaguucuucaagaaggaccucaauuccaagaucaagaacuacuacgggaucaagaccuacaacgacuucccggaggagaagaagauccggaucgaaacguacgcguucaaccuguucaagcagcagaugaugaagaacuucggccgcggcgaguucgccgccguccagcggaucgacgagcgccugaagcuguuccugaccgacaacuucaacaucgaccccauccuccugaagaagaucuaccaccccagcgccaucgagguuuaccagcccccggugcggaagaacgacgggaagcuguaccugggcucccccauggucagcuccaucaggaaccccauggccaugcgggcgcuccaccagcugcgcaagcugaucaacgagcucauccgcaaggagcugaucgacagcaacaccaaggugaacauugagauggcccgggagcugaugaacgccaaugagcgaaaggccuaccagaacuggcagaacgaccgggagaagauucgcaaggaguacgcccucaagaucaagcagcacuuagacgucgacaaggagcccuccgacguggacauacugaaguaccaacucugggaggagcagaaccacaagugcaucuacacggggaaggagaucaacaucagcgacuuccuaggcuccaacccgaaguucgacaucgagcacacgaucccccggagcaucuccuucgacaacucacagagcaacaagacccugugcgagaacuacuucaaccgcuccgugaagaaaaaccggauccccgcggcccuccccaaccacggggagaucaucgagcgccuggagaacuggaagcugaaguacgaggagcucgagaagcagauccaguacgccguccggcaggccaaaggcgcgggcgacaaggacagcaaggaccgugccauccagaagcggcacaagcugaaguucgaguacgacuacuggaagaacaaguacgaccgauucguaauggaggacgugccggaaggguucaagaacucccagcuggucgacaccggcaucaucaccaaguacagccggauguaccucaacacgcuguucgacaagguguacaccgugaaggguaacaccgucgccgacuuccgcaagcuguggggcauccaggacgaauacgagaagaaggcccgcgugaaccacucccaccacugcguggacgccaucacgaucgcgugcaucacuaagagcaacuacgagaaccucgccaaguucuaccacgacugggaggagcuucacgucaaggggaucgaucagcugccgcccaugaacaagcccuggaagacguucacggaggacaucaaagccauccaauacgagauccucgugucccacuacacccccgacaacuuacccaagcagagcaagaagauccugcgcaagaagggccggauccagaagaacgagaacggcaaccccaucuaccucaaaggggacacugugcgcggcucacugcaccagcaaaccuucuauggggccaucgagaagaccgaggucaacaagaagggcgagccggagaaagugaucaaguacgugguccgcaagagccuggacgugcucgacgacuccagcguaaagaacaucgucgacgacaucgugaaggagaucgugcagaacgcccggaucaaggagaaggacuucaucaaggagcuggagauccaaaagcggaagcuggcgaaggccgaggagaacaaggucgugcagauacaggccgagaucgacaagcucaacaagcaggucgccgaccuguacaccaugcccaacaagaacggcaaccccauccccaucaaaaagguccgcaucuuccagaccuccgugacgaacccgauccaccugaagcagcagcgcgacaagagccagaagaccuccaagccccacaaggaguucuacuacgccgcgaacgacagcaacuacaugauggccaucuacgaggggaaggacgagaagggcaaagugaagcgggacuucaagcuccugaacaaccuggaggccggagaguucuucaaguacaguguccacaaggaccucaaggagaagaaccuggagaacauccggaacgugauccccgauaaggugagcgccggcaagaucgagaucccccugaaagcgaucaucaagaccgggaccauggucauccucugggagaacagcccggacgaggugugggaccugacgaucuccgaaguggacaagcggcuguacaaggucgugggcaugagcgugaaccgcaucaaguccgaugucaagaccuucgaguucggcaauaucgugcuccggcacaacaaggaagccagccccgccacccugcugaagauccaggacggggaguucaagagugacgagaacuacauagcccagcgcaagcucagccacaaccaguucaacgcccugguggagggcguggacuucucccugucagugcucggggaaaucaagcggcugaaguga

SEQ ID NO: 7651 - RNA, 4044 nt, Artificial Sequence
  Cas9 variant
augggcgaggacgggaagcccgugcgcgucaagggcaagaccgcuaucggggcgcgucuauuccaggagggccacguggcggccgaccgccggauguuccgcaccacgcggagacggcucaaccgccggaaguggcgccugaagcugcucgacgaaaucuucgacccguacaucacccccguggacagcaccuucuucgcccggcugaagcaguccaaccugagccccaaggacucccgcaaggaguucaaggggagcaugcuguuccccgaccugaccgacaagcaguaccacgaggacuauccgacgaucuaccaccuccggcgcgcucucaugaccgaggacaagaaguucgacauccggauggucuaucuggccauccaccacaucgugaaguaccgcggcaacuuccugaacuccgcgaccguggacaccuucaaggccagcaaggucgacuucaagaaguccuucaaccagcucaacgagcuguacagcgccaucaaccccgaagacgccuuccaaguggacaugaacaaguccgacgagacgggccgacuguuccucgacagcuccauccgcaaguucgacaagcagaagcagaucagcaagcucauccccguggucguggaggacaaggaggcgaagaagcugaacgggaaaaucgcccucgagaucaccaaggccauccugggcuacaaguccaagcugaacguggucacccagaccgagcccgaggacccgaagaagugggccgugaaguucgacgacgaggacaucgauagcaagcucaacgacauccugccugagauggacgagaaccagcaguccaucguggagaucauccaggaccuguacagccaggucacccucaaccaaaucgugcccaacgggaugucccugagcgacuccaugaucaagaaguacaacgaccaccacgagcaccugaagcuauacaagaagcugauagacaacaucagcgacaccaagaagcggagcgcccugaagaccgcguacgacaaguacgugggagacgacgggaagaccauagagcaggacgaguucuacuccaacgucaagaagaaccucgacgacagcgaccuguccaagcagaucgccgaucugaucgaagccgagaaguucaugcccaagcagagaacgucacagaacggcgugaucccgcaccagcuccaccagcgggagcuggacgagaucaucgagcaccaguccaaguacuaccccugguucgcggaggccaaccccaacaagcacgaccugcaccucgcgaaguacaagaucgaggagcugguggccuuccgcauccccuacuacgucggcccgaugauaacccccgaggaccaggagaaguccucccagaccauauucgccuggaugaagcgcaaggagcccgggcagaucacccccuggaacuucgacgagaagguggaccggauggagagcgccaaccgcuucaucaagcggaugacgaccaaggacaccuaccugaucggcgaggacgugcucccggaccagucccugcuguacgagaaguucaagguccucaacgagcugaacauggugcgaguuaacgaccacccccugaaggugagcgagaagcaggccaucuaccgggaccucuucgagaaccagaagcgcaucuccgugaagaaccugcagaacuacgucaagucuaaguccgggcuacccaccggccccaagaucagcggccucuccgacccggaccacuucaacagcucccuggggacguacaacgacuucaagaagauguucggcgacaagguggacgaucccgaccugcaggacgacuucgagaagaugaucgaguggagcaccaucuucgaggacaagaagauccugcgggcgaagcucgacgaaguggccuggcuguccgacacccagaagaacgaguucaaggagauccgcuaccagggguggggccgguuaagcaagaagcuccugacggggaucgucgacggcaacggccagcggaucaucgacgagcuguggaacacgaacaagaacuucaugcagauccagagcgacgacuccuucgccaagcggauccacgaggccaacgccaaccagaugaaggcgaccgacguggaggaugugcucgccgacgccuacaccagcccccagaacaagaaggccauccgccaggucgugaagguggucgacgacauccagaaggcgaugggcgggguggcccccaaguucaucuccaucgaguucacccggucugaggaccgcaacccgcggcgcacgaucucccggcagcgccagcuggagaacacccugaaggacaccgcccaagcccucgucaagagcaucaaccccgacaucuuguccgagcuggacaacgccagcaaguccaagaaggggcucaccgaccggcuguaccuguacuucacgcagcucggcaaagacauguacaccgggaagcccauuaacaucgacgagaucagcaacuacgauaucgaccacaucuucccgcaggcguucaucaaggaugacucccugaacaaccgcguguuggugagcaaggccggcaacaacggcaaguccgccaacgugccccucaaacuuuucggggccaagaugggcggguacuggaagcagcuggccgacgcgggccucaucgggcagcgcaagcugaagaaccugcagaccaaccccgacaccaucagcaaguucgccaugcacggcuucauccggcgccagcucgucgagaccucccaggugaucaagcugguggccaacauccugggcgacaaguaccggaacgacgacacgaagaucaucgagaucaccgcccgcaugaaccaccagaugcgggacgaguucggguucaucaagaaccgcgagaucaacgacuaccaccacgccuucgacgcguaccucaccgccuuccugggccacuacuuguaccaccgcuacaucaagcuccgccccuacuucgucuauggggacuucaagaaguuccgggaggacaaggugaccaugcgcaacuucaacuuccugcacgaccugacggacgacaagcaggagcggauagccgacaccgagaccggcgaggugaucugggaccgcaagcgcagcauacagcagcuccgcgacgucuaccauuacaaguucaugcugaucucccaggagguguucagccugaacaaggagauguucaagcagaagcuguucccggccacccucgcgaagaaguccaagcugauccagaucaagaaggacaagcccguggacaucuacggcggguacagcaacaacacggacgccuaccucaccgucgugaagcugaagggcucuaaggaggacaaguacaagaucguggggguccccaugagagcccuggacaaccucaaacacgccgagaaggagagcccccagagcuacaccgccgagcugcgcaaggcgcuggagccgcaguucaccaagaucaagaagaaccggaagacgggcgagguguccaagguggucaccaacuucgacaucgugcucggccgccuauucuaccggcagauggugauagacggcagcgagaagucccugaucgccagcuccgucuaccaguacaacgccaagcagcuggugcugagcgaccaggccauccgcaccaucuccgaccaggagggcaucgacgaguucgagcugagcucccaguacgacaagguauacgacgagaucguccagaagguggagaagcuccugcccaucuuccagcaccggcacuuccaggagcgccugaacaacgguaagagccuuuucgugaaccugcccguccacgacguguacgaggggaacaagcuggagcaggucgggaaaaagcacauaaucaacuccauccucggcgggauccacgccaacgcggaccgccccgacaucgaccuguucggcaucaagaaccugggccaguuuagcuccaccagcgggaucaaccucuccagcgacgccaucaucugcuaccagagcccgacgggccuguucgagcggcgcgucgugcugaaggaccucuga

SEQ ID NO: 7652 - RNA, 4044 nt, Artificial Sequence; identical to SEQ ID NO: 1852
  Cas9 variant

SEQ ID NO: 7653 - RNA, 4044 nt, Artificial Sequence; identical to SEQ ID NO: 1853
  Cas9 variant

SEQ ID NO: 7654 - RNA, 4047 nt, Artificial Sequence
  Cas9 variant
augaagaagcccuacaccaucgcccuggauaucggaaccaacucagugggaugggucguggugacggacgacuaccgcgugccgaccaagaagaugaagguauuagguaacaccgagcggaagacuaucaagaagaaccugaucggggcccugcuguuugacuccggcgacacggcggaggggacccgccugaagcggaccgcccggcggcgcuacacccggcgcaagaaccgacugagauaccucaaggagaucuucacggaggagauggcgaagguggacgacggcuucuuccagagacucgaggacaguuucuacguccuggaggacaaagagggcaacaagcaccccaucuucgccaaccucgccgacgagguggcguaccacaagaaguaccccaccaucuaccaucuccgcaaggagcugguggacaacccgcagaaggccgaccuccgacugaucuaccuggcagucgcccacaucaucaaguuccgcgggcacuuccucaucgagggcacccuguccagcaagaacaacaaccugcagaagucauucgaccaccucguggacaccuacaaccugcuguucgaggagcagcgguuacugacggaggggaucaacgcgaaggagcugcucagcgccgcccugagcaagagcaagcgccuggagaaccugaucucccucaucccgggccaaaagaagaccgggaucuucggcaacauuaucgcccugagccucggccugacccccaacuucaaggccaacuucgggcuuuccaaggacgugaagcuccagcuggcgaaggauaccuacgccgacgaccuggacagccuccuggcccagaucggagaccaguacgccgaccuguuccucgccgcgaagaaccuguccgacgccauccugcucucagacauccugacggaguccgacgagaucacccgggccccgcuguccgccuccauggucaagcgcuaccgggagcaccacaaggaccucgucacccugaagacccugaucaaggaccagcuccccgagaaguaccaggagaucuuccuggacaagacgaagaacggguacgccggcuacaucgaaggccaggugagccaagaggaguucuacaaauaccugaagccgauccuggcgcgccucgacggguccgaaccccugcugcuuaagaucgaccgggaggacuuccugcgcaagcagcgcaccuucgacaacggcagcauuccccaccagauccaccuggaggagcuccacgccauucugcggcgccaggaggucuucuaccccuuccugaaggacaaccggaagaagaucgagagccuccugaccuuucgcaucccauacuacguggggccccuagcccggggccacucccgcuucgccugggugaagcggaaguucgacggggccauccgcccguggaacuucgaggagaucgucgacgaggaggcgagcgcccagauuuucaucgaaaagaugaccaagaacgaccucuaccugccaaacgagaaggugcugccgaaacacucccuccuguaugaaacguucaccgucuacaacgagcucaccaaggucaaguacgccaccgagggcaugacgcggccccaguuccucucugccgaccagaagcaggcgaucguggacuuacuguucaagaccaaccgcaaggugaccgucaagcagcucaaggagaacuacuuuaagaagaucgaguguugggacuccguggagaucacaggggucgaggacagcuuuaacgccucccuggggacguaccacgaccugcuaaaaaucauccaggacaaggacuuccuggacaaccccgacaaccagaagaucaucgaggacaucauccugacccucacccuguucgaagacaagaagaugauuagcaagcggcuggaccaguacgcccacuuguucgacaaggugguacugaacaagcuggaaagacaccacuacaccggcuggggacggcucuccggcaaacugaucaacgggauccgggacaagcagucgggcaaaacgauccuggacuuucucaaggccgacggcuuugccaacaggaacuucaugcagcugauccacgacuccgagcugucauucaucgacgagaucgcuaaggcccaggucaucgggaagaccgaguacuccaaggaccuuguggguaacuuagccgggagccccgccaucaagaagggcaucucccagaccaucaagaucguggacgagcugguuaagaucaugggguaccucccgcagcaaaucgucaucgagauggcccgcgaaaaccagaccaccgcucagggcaucaagaacgcccggcagcgcaugaggaagcuggaggagacggccaaaaagcugggcagcaacauucuuaaggagcaccccguggacaacucccagcugcagaacgacaagcgcuaccuguacuaucuccagaacgggaaggacauguacaccggagacgaccuggauauagacuacuuaagcuccuacgacaucgaucacauuaucccccagagcuucaucaagaacaauagcaucgacaacaagguccucaccucccagggggccaaccgcggcaagcuggacaacguacccuccgaggccaucgugcggaagaugaagggcuacuggcagucccugcuccgcgcgggggccaucagcaagcagaaguucgacaaccugaccaaggcagagcggggcgggcugacgcaggucgauaaggccggcuucauccagaggcagcucguggagacccggcagaucaccaagcacguggcacagauccuggacucccgcuucaacaccgaguucgacgaccacaacaagcggauccgcaagguccacaucaucacgcucaagagcaaguuaguguccgacuuccgcaaggaguucgggcuguacaagauccgagacaucaaccacuaccaucacgcccacgacgccuaccugaacgccguggucgccaaggcgauccucggcaaguacccgcagcuggcccccgaguucguguacggcgacuacccuaaguacaacagcuucaaggagcggcagaaggcaacccagaagaugcuguuuuacuccaauauccucaaguucuucaaggaccaagaaagccugcacgugaacuccgacggggaggagaucuggaaugccaacaagcaccuccccauuaucaagaacguccugagcaucccccaggugaacaucgugaagaaaacugagguccagaccggcggguucuacaaggagucaauacugagcaagggcaauuccgacaagcugaucccccgcaagaacaacugggauacgagaaaguacggaggcuucgacagccccaccguggccuacuccgugcucguuaucgcgaagauggagaagggcaaggccaaggugcugaagccggugaaggaaauggucgggaucaccaucauggaacgcaccgccuucgaggagaaucccgugguguuccuggaggcccggggcuaucgcgaaauccaggagcaccucaucauuaagcugccuaaguacagccuguucgaguuagagaacgggcggcgcaggcugcuugcaagcgcuagcgagcuucagaaggguaaugagcuguuccugccggucgacuacaugacguuccucuaccuggccgcccacuaccaugagcugaccgggagcucggaagacgugcuccgcaagaaguacuucguggaccggcaucugcacuacuucgacgacaucauccagaugaucaacgacuucgccgagcgccacauccuggcgagcuccaaccuggagaagaucaaccacaccuaccacaacaacagcgacuuaccugucaacgagcgcgccgagaacaucaucaacguauucaccuucguggcccucggcgcccccgccgcguucaaguucuucgacgccacgaucgaccggaagcgcuacaccuccaccaaggagguccucaacgcaacccugauccaccagagcgugacgggucuguaugaaacacggaucgaccugucccagcucggggagaacuga

SEQ ID NO: 7655 - RNA, 4047 nt, Artificial Sequence
  Cas9 variant
augaaguccgagaagaaauacuacaucggccuggacguggggaccaacagcgucggcugggcggugaccgacgaguucuacaacauccuccgcgccaaggggaaggaccuguggggcgugcggcuguucgagaaggcgaagacggccgccgacacacgcaccuuccggagcgggcgccggcgcaacgacagaaagggcguucgccuccagauccugcgggagaucuucgaggacgagaucaagaagguggacaaggacuucuacgaucgccuggacgaguccaaguucugggccgaggacaagaaggugagcggcaaguacucccucuucaacgacaagaacuucagcgacaagcaguacuucgagaaguuccccaccaucuuccaccuccggaaguaccugauggaggagcacggcaaggucgacauccgguacuacuucuuggccaucaaccagaugaugaagcggcgcggccacuuccugaucgacggccagaucucccacgugacggacgacaagccgcugaaacagcagcucauccuucugaucaacgaccuccugaagaucgagcuggaggaggaguucauggacagcaucuucgagauccucgcggacgugaacgagaagaagaccgagaagaagaacauccugaaggaacugaucaacgcccaggacuucaacaagcaggagggcaagauccucuacuccaucuucgagagcaucgucaccgggaaggccaagaucaagaacaucaucuccgacgaggacauucuggagaagaucaaggaggacaacaaggaggacuucgugcugaccggcgacagcuacgaagagaaccuccaguacuucgaggaggugcugcaggagaacaucacgcuguucaacacccucaaguccgccuacgacuucgucauccugcagagcauccugaagggcaaguccacccucagcgacgcccagguggagcgguacgacgagcacaagaaggaccuggagauccugaagaaggugaucaagaaguacgacgaggacgggaagcuguucaagcaggucuucaaggaggacaacggcaacggguacguguccuacaucggcuacuaccugaacaagaacaaaaagaucaccgcgaagaagaagauaagcaacauagaguucacgaaguacgugaagggcauccuggagaagcagugcgacugcgaagacgaggacgucaaguaccuccuggggaagaucgagcaggagaacuuccugcucaagcagaucuccagcaucaacagcgugaucccccaccagauccaccuguucgaguuggacaagauccuugagaaccuggccaaguauuaccccuccuucaacaacaagaaggaggaguucaccaagaucgagaagauccguaagaccuucaccuuccggauccccuacuacgugggcccgcugaacgacuaccacaagaacaacgggggcaacgccuggauauuucgcaacaagggagagaagauccggccauggaacuucgagaagaucgucgaccuccacaagagcgaggaggaguucaucaagcgcaugcugaaccagugcacguaucugcccgaggagacaguucucccaaaguccucuauccuguacuccgaguacauggugcugaacgagcugaacaaccuccggauuaacggcaagccgaucgacacggacgucaagcugaagcugaucgaggagcuguucaagaagaagaccaagguaacgcucaagagcauccgcgacuacaugauccgcaacaacuucgccgacaaagaggacuucgacaacuccgagaagaaucuggaaaucgucagcaacaugaaguccuacaucgacuucaacaacauccucggcgacaaguucgagcuggagaugguggaggaccugauugagaagaucaccauccacaccgggaacaagaagcuccugaagaaguacaucgaggagaccuaccccgaccugagcuccagccagauccagaagaucaucaaucucaaguacaaggacuggggcagacugucccgcaagcugcucgacgguaucacgggcaccaacaucgagaccggugagaucgacaccgugaucaacuuccugcggaacagcuccgacaaccugaugcagaucaucggcagccagaacuacuccuucaacaacgacaucgacaagcuccgcaagaaguacaucccacaagagaucagcuacgaggucguggagaaccuguacgugucccccagcgucaagaagaugaucuggcaggucauccggaucacggaggagaucaccaaggugaugggcuacgacccggacaagaucuucaucgagauggccaagagcgaggaggggaagaagaccaccaucucccgcaagaacaagcugcucgcgcuguacaaggccaucaagaaggacgagcgcgacagccaguacgagaagcugcucacgggccugaauaagcuggacgacuccgaccuccgcagccggaagcuguaccuguacuacacccagaugggacgcgacauguacaccggcgaaaagaucgaccucgacaagcuguucgacuccacccacuacgacaaggaccacaucaucccacaaagcaugaagaaggacgacuccaucaucaacaaccuggugcucgugaacaagaacgccaaccagacgaccaaggggaauaucuaccccgugcccagcuccauccggaacaacccgaagaucuacaacuacuggaaguaccugauggagaaggaguucaucagcaaagagaaguacaaccgccugauccggaacacgccccucaccaacgaggagcugggcggcuucaucaaccgccagcuggucgagacucgccaguccaccaaggcuaucaaggaacuguucgagaaguucuacaagaaguccaagauaauccccguuaaggcgauccuggccagcgaccugcgcaaggacaugaacacccucaagagccgggaagugaacgaccugcaccacgcccacgacgccuuccugaacaucgucgccggggacguguggaaccgcgaguucaccuccaaccccaucaacuaugugaaggagaaccgggagggcgacaaggucaaguacagccucuccaaguacuucacccgcccgcgcaaaagcaaggggaaagugaucuggacucccgagaagggcaggaagcugaucguggacaccuuaaacaagcccagcguccucaucuccaacgagagccacgugaagaagggcgagcuguucaacgcgaccaucgccgggaagaaggacuacaagaagggcaagaucuaccugccccucaagaaggacgaccgccugcaggacguguccaaguacgggggcuacaaggccaucaacggggccuucuucuuccuggucgagcacaccaagagcaagaagcggauccgcuccaucgagcuguucccacuccaccuccugucuaaguucuacgaggacaagaacacggugcuggacuacgccaucaacgugcugcagcuccaggaccccaagaucaucaucgacaagaucaacuaccggaccgagauuaucaucgacaacuucuccuaccugaucagcaccaaguccaacgacggcagcaucaccgucaagcccaacgagcagauguacuggcgcguggacgagaucuccaaccugaagaagaucgagaacaaguacaagaaggacgcgauccucacggaggaggaccggaagaucauggagagcuacaucgacaagaucuaccagcaguucaaggccgggaaguacaagaaccgccggaccaccgacaccaucaucgagaaguacgagaucaucgaccuggacacgcuggauaacaagcagcucuaccagcugcugguggccuucauaucccucagcuacaagaccuccaacaacgccgucgacuucaccgugaucgggcugggcaccgagugcgggaagccccgcaucacgaaccugccggacaacaccuacuuaguguacaagucaaucaccggcauauacgagaagcggauccgcaucaaguga

SEQ ID NO: 7656 - RNA, 4047 nt, Artificial Sequence; identical to SEQ ID NO: 1856
  Cas9 variant

SEQ ID NO: 7657 - RNA, 4047 nt, Artificial Sequence; identical to SEQ ID NO: 1857
  Cas9 variant

SEQ ID NO: 7658 - RNA, 4047 nt, Artificial Sequence; identical to SEQ ID NO: 1858
  Cas9 variant

SEQ ID NO: 7659 - RNA, 4047 nt, Artificial Sequence; identical to SEQ ID NO: 1859
  Cas9 variant

SEQ ID NO: 7660 - RNA, 4047 nt, Artificial Sequence
  Cas9 variant
augaagaagcccuauaccaucgcccuggacaucggcaccaacagcguggggugggucguggugacagacgauuacaggguaccgaccaagaagaugaaggugcucggaaacaccgagcggaaaaccaucaagaagaaccugaucggggccuuacuguucgauuccggcgacacggcggaagguacccgccugaaacggaccgcucgcccccgguacacccgccggaagaaccgccugcgguuccucaaggagaucuucacggaggagauggccaagguggacgauggcuucuuccagcgccuggaggauagcuuuuacguccuggaagacaaggagggaaacaagcauccaaucuucgccaaccuggccgacgagguggcguaccacaagaaguaucccacuaucuaccacuugcggaaggagcugguggacaacccgcagaaagccgaccuccgccugaucuaccuggccguggcccacauuaucaaauuccgggggcacuuucucauagagggcacccucaguagcaagaacaacaaccugcagaaguccuucgaccaccucguggauaccuacaaccugcuguucgaggagcaacgccuccugacggaggggauaaacgcgaaggaacugcuaagcgccgcccugagcaagagcaagcggcuggagaaccucaucucccugauccccggccagaagaagaccgguauauucgguaauaucaucgcccugucccucggccugacccccaacuuuaaggccaacuucgggcuguccaaggaugugaagcuccagcuggccaaggacaccuacgccgacgaccuggauagccuccuggcccagaucggcgaccaguacgccgaucuguuccucgccgccaagaaccuguccgacgccauccugcucuccgacauuuuaaccgagucagacgagaucacccgugcgccccugagcgccuccauggucaagcgguaucgcgagcaccacaaggaccucgugacccucaagacccugauaaaggaccagcucccggagaaguaucaagagaucuuccuggacaagacgaagaacggguacgccggcuacaucgagggccaggugagccaggaggaguucuacaaguaccugaaacccauccuggcccggcucgacggcuccgagccacugcugcuuaagaucgacagggaagacuuuuuacggaagcagcgcaccuucgacaacggcagcaucccccaccagauccaccuggaggaacuccacgccauccugcgccggcaggagguuuucuacccguuccugaaagacaaccgcaagaagaucgagagccuccugaccuuuaggauccccuacuacguggggccccuggcccgcggccacucacgcuucgcaugggugaagcgcaaguucgacggagccauccggcccuggaacuucgaggagaucgucgacgaggaggcgagcgcccagaucuuuaucgagaagaugacgaaaaacgaccucuaucugccgaacgagaaggugcugccgaagcacuccuugcuguacgagacauucaccguguacaacgaacugaccaaggucaaguacgccaccgagggcaugacgaggccccaguuccuuagcgccgaccagaagcaggcgaucguggaccuguuauucaagaccaaucggaaggugaccgucaagcagcuaaaggagaacuacuucaagaagaucgagugcugggauucgguggagaucaccggcgucgaggacagcuucaacgccucccuggggacguaccaugaccuacucaaaaucauccaggacaaagacuuccuggacaaucccgacaaccagaagaucaucgaggacaucauccugacccucacccuguucgaggauaagaagaugaucagcaagcgccuggaccaguacgcccaccucuucgacaaggugguccugaacaagcuggaacggcaccacuacaccggcugggggcgccucuccggcaagcuaaucaacgggauccgggacaagcagagcggcaagacgauccuggacuuccuuaaggccgacggguucgcuaaucgcaacuucaugcagcugauccacgacuccgagcugagcuucaucgacgagaucgcgaaggcccaggucaucgggaagacggaguacucaaaggaccucgugggcaaccuggcagguagcccggccauuaagaagggcaucucccagaccauaaagaucguggacgaacuggucaagaucaugggguaccucccccagcagaucgugaucgagauggcccgcgagaaucagaccacggcacagggcaucaagaaugcccgucagagaaugcgcaagcuggaggagacggccaagaaacugggcagcaacauccugaaagagcacccuguagacaacucccagcugcagaacgauaagcgguaccuguacuaccuccagaacgggaaagacauguacaccggcgacgaccuggacaucgacuaccugagcucuuacgacaucgaccacaucaucccgcagagcuucaucaagaacaacagcaucgacaauaagguccucaccucccagggggccaaccggggcaagcuggacaacgugccaagcgaggcaaucguacgcaagaugaaggguuacuggcagucccugcuccgggcgggggcuaucagcaagcaaaaguucgauaaccugaccaaagccgagcgcggaggacugacgcaggucgauaaggccggcuucauccagcuccagcucgucgagacccggcagauuaccaagcacguggcgcagauccuugacagucgcuucaacaccgaguucgacgaucacaacaagcggauccgcaaggugcacauaaucacgcucaagagcaaacugguguccgacuuccggaaggaguucggucuguacaagauccgcgacaucaaccauuaccaccacgcccacgacgcguaccucaacgcagugguagcaaaggcgaucuugggcaaguauccacagcuggcccccgaauuuguguacggcgacuaccccaaguacaacagcuucaaggagcggcagaaggcuacccaaaagacccucuucuacuccaacauacugaaguucuucaaggaccaggagagccugcacgugaacuccgacggggaggagaucuggaacgccaacaagcacuuaccaaucaucaagaacguccugagcaucccucaggugaacaucgugaagaagaccgaggugcaaacgggcggguucuacaaggaguccauccugagcaagggcaacuccgauaagcucaucccaagaaagaauaauugggacacccggaaguacgggggcuucgacagcccgaccguggccuacuccgugcuggucaucgcgaagauggagaagggcaaggcaaaagugcugaagccagucaaggagauggucggcaucaccaucauggaacgcaucgcauucgaggaaaacccagugguauucuuggaggccaagggcuaccgggagauacaagagcaccugaucaucaagcugcccaaguacagcuuauucgaguuggagaacgggcgccggcgccugcucgcgagcgcauccgagcugcagaagggcaaugaacucuuccucccggucgacuacaugacguuccuguaccuggccgcccacuaccacgagcucaccgggagcuccgaggacgugcuacgcaagaaguacuucguggagcgccaccuccacuacuucgacgacaucauccagaugaucaacgacuucgccgaaagacacauccuggcgagcuccaaccuggagaagaucaaccacaccuaccacaacaacucugaccugcccgucaaugagagagccgagaacaucaucaacguguucaccuucguggcccucggcgccccugccgcguucaaguucuuugacgcuacgauugaucggaagcgcuacaccuccaccaaggagguccuaaacgccacccugauccaccagagugugacgggccuguacgagacccgcauagaccucucccagcugggagagaacuga

SEQ ID NO: 7661 - RNA, 4050 nt, Artificial Sequence
  Cas9 variant
augaagcagaaguucuacgugggccuggacauggggacggccagcgugggcugggccgugaccgacgacaaguacaacaucaucaagcgccacgggaaagcgcucuggggcgugcggcuguucaagacagccaacaccgccgaggagcgccggaucuuccgcgccgcccggcgccggacccagcgccgcaagcagcgcauggagcugcuccaggagaucuucggggacgaaaucuccaagaccgacaucggcuucuaccagcggaugaaggagagcaaauacugguuugaggacaagcgcgacaucaacggcaagcagcccgagcugccguacgcgcuguucgucgacgacggguucacggacaaggacuaccacgagcaguuccccaccaucuuccacuugcggaacgugcuggugaacgaguggacccaaaaguacgacauccgccuggucuaccucgcaauccaccacaucaucaagcacagaggccacuuccuguucgaggggaagaagaugagcgaggugaccgacuucggcagcgccuuugaggccuucugcaagguggcguccgacaacgacaucgagaucacggucgacgaggagaagcugaaggacaucgaggaccuccucaagagccgccagaaguccaagaccgccaagaagcaggagcuggggaagaucaucgccggcgccgacaagcagaagaaggcacucgcggcccuggugaccggcugcauggugaagcugucagagaucuucgccgacaagucccucgacgacggggagcggaacaagaucagcuucgccgacuccaacuacgacgaguacaucgccaacgucgaggagacccuggcggagcgcuuccugcucaucgccgccggcaaggcccuguacgacugggcagugcugagcgacauccucgaggggucuacguacaucagcgaggcgaaggugaagaucuacaagaagcacggcgacgaccugcggaagcugaagggccuccugaaaacccgucccgacgaguacaagcugaucuuuggacuccccgagaagcaggccaacuacuccgccuacaucggcauggucaagaagaacgggaagaaggugccgaucgacaagaagugcaccaaggccgacuucuacagcuuccugaagaagacccugaauaagaucaacuucgaggacgagaaggagcgggagaucgccgaguccaucaucaacgagaucgagaacgagacguuccuccccaagcaagucaucagcgacaacggcgugauccccuaccagcugcacgaggcggagcuggaccgcauacucaagaacgccgcccuguacuaccccuuucuguccgagaaggacgacgagggguacacgaacauggacaagaucaaggccaucuucaaguuccgcaucccguacuacgugggcccccucaacaccuaccacagcgacaagggcgggaacagcugggcggugcggaagcaggacggcaagaucuaccccuggaacuucgaguccaagaucgacgcgggggagagcgcccgcaaguucaucggccggaugaccaacaagugcacauaccugaucggaaaggauguccugcccaaggagucccuccuuuacagcaaguucauggugcugaacgagcucaacaaccugcgcauagacggcgagaagguuucggucgagauaaagcaggccguguacgagaacgucuucaaaaaguaccagagagugaccggcaagaaggucaaggauuuccucauccgcagcggcaucaucggucgggagcaggagcucaguggguucgaccagaacuucaagagcucccugaaggccuaccacgacauaaagcagaucgcgggcgacaucaaccugagccagaaccagaaggaggacaucaucaaggagaucaccgucuucgccgacucccagaagaugcugaagaagcgccucaagaucaaguacccagagcugagcgacaagcaggucaccaagcuggccgccaagaaguacacgggguggggccggcucucccgcgaguuccuggaggaggucgagagcgugaacaaggagaccggcgaggugcugaacaucaucuccgcucucugggagaccaacgagaaccugaugcagcugcucagcaacaaguacgacuaccuguccgagaucaagcgguuaaacgacgaggcggaggacaagagcgagguggucaccuacgacgacgugcagaaguuauacgugucccccgcggucaagcgccccguguggcagacgcugaagaucguggaggagaucagcaagaucauggggagcaagcccgagcggaucuucgucgagauggcccgggaaccgggccagaagggggaugugaaggugucccgcaagagcaggcugcucgagaaguacaaguacugcaagaaggaggccccagagaucuacgagaaccuggucaaggaggacgacaacaagcugcgguccgacaagcuguuccuguacuacacccagaugggccgcugcauguacagcaacgaagugaucgacaucgaagaccuguucaccaaccgguacgacaucgaccacaucuacccccaguccaaggugauggacgacagccucgacaaccgcguccucgugaagcgcgagcugaacuccaacaagaccgacgucuuccccgucccgaaagaguacauggacaaggccaagacgcucugggacaugcugaagaagaaggaccugaucagcaaggagaaauaccaccggcucacccgccgggacggcuucuccgagaacgagcugagcggguucaucgcgcgccaacugguggagacccggcaguccaccaaggccgugacgcagcuccugaccaaggccuaccccgagagcgagaucgucuacgccaaggcgaacgccguguccgaguuccgacacaaguucggauucacaaaggugcggagcauuaacgacuaccaccacgccaaggacgccuaccuaaacaucgucguggggaacaccuacuacgugaaguucaccaaggacgccgcgugguuuauccgcaacaaccccggccggacguacaaccucaagaagauguucgagcaggggaccgucucccgcggcggcgagaccgccugggugagcggggaggauggcaccaucuucacggugaagcgggucauggggaagaacaacauccuguucacccgcaaggccuacgaggugcggggcggguuguucgaccagcagaucaugaagaagggcaagggccagauucccgugaagaacaacuccgaggacgaccgacucugcgccaccgagaaguacggggccuacaacaaggcgagcggagccuacuucaugcuggucgagagcgaggacaagaaggggaacaagauccggacucuggaguucgugccgguguaccucgccaaggagcuggagaaguccgaggacgccgccauccgcuacugcgucgagaagcucgagcucaagaaccccgacgugcgggugcgcaagaucaagauggacagccuguucaacgucgacggcuuccggaugcaccuguccggccgcacgggcaagcagcucaucuucaagugcgcggagcagcuggugcuggacgaggagagccagaagauccucaagaagaccgccaagguguuugccgacuacaaggagaacaagaacaucaagaucagugacaagaucgagcugacugacgagaugcugaucaagcucuacgagcuguucuacaaaaagcugaaggacaccgucuacaacauccggcucagcacccaggugaagacgcuggaguccggcaaggagaaguucgagaagcugagccuccuggacaagugcuuagugaucgaggagauccuccaccuguuucagugccaguccgucgccgcgaaccugagcuccaucgggggcgccgccaccgccgggauccucgugcugaacaacgagaucagccgcugcggcaaggucgagaucaucaaccaguccaucacuggguucuacgagcaggucaucgaccugaagaacaucuga

SEQ ID NO: 7662 - RNA, 4050 nt, Artificial Sequence
  Cas9 variant
augcagaaguacuaccugggccucgacaucgggaccaacagcgugggcugggcggucaccgacgagaacuacaaccugugcaaguucgggggcaagcgcaugugggggauccggcuguucgacggcgcacagacggcggaggagcgccggaugaaccgcuccaaccggcgccggcucagccgccagaagcaacggaucgaccuguuacaggagcuguucgccaaggaaaucgccaagguggaccccaccuucuuuauccgccugaaugagucccggcuguacauggaggacaaaaguaccggcaccaaguuuccccucuucgccgacccgggauacacagacaaggaguacuacaaggaguaccccaccaucuaccaccuccgccaggagcugaucaagaaccccgagucccacgacauccgguugguguaccuggccugccaccacauccugaagaaccgcggccacuuccucaucaacgggagcuuuuccgaccuuaagaaccugagcuucgucugccgggagaugcucgacgcuuucaacgagcuauccaaguaucagcugaugauuagugacaucgacgcccucgaaaagauccuguccgaccgcaagcaacagaaguccgccaaggugaaagagcuggugcagaucuucgagugcgucccgcgagaggacaagagcgacgcgaagaucugcaaggagauccucagcaaccuaugcaaguuccugguaggcgccaaggggaacaucacccgccuauucgacaccgacuuugacgagauggagacauccucguucuccuucggggacagcaaguacgaagacucccugcugcccagccucgaggagaacuacccugacuacgccaacgugauccagaagaucaaggcuauguacgacuggagcguccugguggagaucauggccggagagaacuaccuguccuucgcuaagguuaaugcguacaagaaacacaaggagaaccucagcauccugaagucccucaugaagaaguacugcacccccgacgucuaccagcgguucuucuacgagaccgacgagaaguccagcuacgguaacuacaucggcgccauccacaacaacggacacagccacacaaugaagaagugcgacgaggagacuuucuacaagucccucagcaagauccuggacaagcugguuguccagaagacagaccaggacacccuagagauccugaagaaggaggcgaagaaccagacccugcucccgcuggcccgcacgaaggccaacggcgugauacccaaccagauccacauccaggagcugcgggcgauccucgacaacgcuaaaaccuaucugagcuuccugaacgaggccgacgaguacgggacaaucgccgagaagaucauccgcaucgccaaguucaagauccccuacuacgcggggccucucagcacucgccacaaggagcagggcgccaauacguggauagugcggaagcaggagggacgcaucuacccguggaacuucgaggaaaugguggaccuggagcguuccaacaacgaguucauccgccggaugaccaacaagugcaccuaccugaucggcgaggacguccugcccaaaaacagccuccuguacuccaaguucauggugcugaacgagcucaacaaccugaagauccgcgggcacaagaucagcguggagcugaagcaggagcucuacaaggagcuguucugcaagaaggccaaggucaccggcaaggcccugcucguguaccugaaaaagaaggacgccgagcugacacucgaggacaucuccggcuucgacgcggauuuuaaaagcagccugagcaucuauaucgacuucaaaaaccacaucuuacgggagcagaucgacgaugggaaguaccaauccaucguggagaacaucaucaaguggaagaccauuuucgacgucgacagcaagaugaucgagaaacuuauugcccgcgaguaccccaacauguucagcuccgagcagaucaagaagaucugccggcugaagugccgcggcugggggaacuucagcuccagguuccugaacggcauucagggagagaacaccgagaccaaggagugcuucacgaucaucgaggcccuauggaagaccaacuacaaucugaugcagcugcucagcaagcaguucacuuucaaggacgcaaucgacugcauuaacgcggacaaggugggcaagaucgacaaggucacauacgagaacacaguaaaggaccugguggucucccccgccaacaagcgcgccaucuggcagaccgugcaaaucaccgaggagaucaagaaggugaugaagugcgagccggagaagaucuucgucgagauggcccggggcggggaaaaggagaagaagcgcaccaucagccggaaggagcgccuucucaagcuguacauggacuacaaggacgagaaccgggacuggaucaaggagaucgagucacgcgacgagcaggauuucacgaaccggaagcuguauuuguacuacacccagauaggacgcugcauguacagcggggaggagaucucccuggaggaacugaugcagaagaacagcaagugggacaaggaccacauuuacccccaguccaagaucaaggacgacagccucgacaaccuggugcuggcccgcaaggacaucaacaacaacaaguccaacaagcucuuacccaccggcauccaggacaagaugaagaaguacuggaagaugcugcucaaguacggguucaucucuaagaagaaguacgaccggcugaugcgcaccgaggacuucuccgacgaggaguuauccggauucaucgcgcggcagaucguggagacccgccaguccagcaaggccgucgccgagcuccuggagcaccugaacgagcacacggagaucguguacgugaaggccgagcuggucagcgacuuccggcacgacaacaacaugcugaagucccgccggaucaacgacuaucaccacgccaaggacgcauuccugaacaucguggugggcaacgucuacaacgccaaguuuaccgccaacccucgcaacuggaucaagaagaaccggaacaccaacuacagcauccgccggguguucgacuacaccguuaagcgcggguccacaaucguuuggcagggcguaaaggacgggggccacagcaucgacgguaucaagaagaccauggcccggaacgauauccucuacaccgagcgcaccuacugcgagcagggggagcuguucaacgcgacgcugauaaagaagggcaacccgaacgcgaucgggcucaagaagggccuggaccccaugaaguacgggggcuacagcagccccaagaccuccgccuucgccuucauagaguuugacggcaagaaggggagacagaaccaccugguggagauccccguguacaucgccaauaucgcggcccgccagccggaguacauaaagaaccaccucgaggagaagaaaggcuaccagaacgugaucguaaagaaguaccccauccagaagaacgcccugaucaaguuagacggguacccagcccggcuccgcggcgccaacgagaaauccaucacccugaagaacgcaguccagcuggugcucaagcccgaguaccacgaaacaauucggaacguggagaaguacuuagaguacaucgacaaggacgagagcgucagcaaggccgcuagguucucccacacggagcuggacaagcucuacgacgaguugugcuucaaggccgagaacagcaucuauaagaagcggcccgccaaccaguccgcgacccugaagaacggucagaaaaccuuccucgccaucaccaaccugaaggagaaggcccaggugaucaacaacaucaucacgauguuccgcugcgacgccaccaccaccacgaaccugaaaaccaucgggggcucggccaacgcagggggcaugcaggucaauaagaacacccucaccucccagaaggucgugcuggugcaccagagcaucacggggcuguucggcacagaggaggaguuacuguga

SEQ ID NO: 7663 - RNA, 4053 nt, Artificial Sequence
  Cas9 variant
augaagaaacccuacagcauugggcucgacauagggaccaacuccgugggcugggcuguagugaccgacgacuacaaggugccggccaagaagaugacuguccucgggaacaccgacaagagccacaucaagaagaaccugcuaggagcgcuccuguucgacuccggcaacaccgccgccgaccgcagacugaagcgaaccgcgcggcgccgcuacacgcgccgacgaaaccggauccucuaccugcaggagauauuugccgaggagaugagcaagguggacgacucuuucuuucaccgccuggaggacagcuuucucguuaccgaggacaagcggggcgagcgccaccccaucuucggcaaucucgaagaggaggucaaguaccacgagaauuuccccaccaucuaccaccuucggcaguaccucgcagacaacccggaaaaaguggaccuccgccucguguaccucgcccuggcccacaucauuaaguuucgggggcacuuccugaucgagggcaaguuugacacccgcaacaacgaugugcagcggcuguuccaggaguuccuugccguguacgacaacacguucgagaacuccagucuacaagagcagaauguccagguggaggagaucuuaaccgacaaaaucuccaagagcgcgaagaaagaccgcguccugaaacuauucccgaacgaaaagagcaacgggagauucgccgaguuccugaaacugaucgugggcaaccaagccgauuucaagaagcacuucgagcucgaggagaagacgccgcuccaguucuccaaggauaccuacgaagaggagcuggagguccugcucgcccagaucggagauaacuacgcugagcuguuccuguccgcaaagaaguuauacgacagcaucuuacuguccggcaucuugacgguuaccgacgucagcaccaaggcgccgcuguccgccagcaugauccagcgauacaaugagcaccagauggacuuagcccagcugaaacaguucaucaggcagaagcuguccgacaaguacaacgaggucuucagcgaugugucuaaggacggcuacgccggauacaucgacgggaaaacuaaccaggaggccuucuacaaguaccugaagggccuccugaacaagaucgagggauccggcuacuuucuggacaagauagagcgcgaagacuuucuccgcaagcagcggacguucgacaacgggagcauaccccaccagauucaccuccaggagaugcgcgcgaucaucaggcgccaggccgaguucuacccauuccuggccgacaaccaggacaggauagagaaaauccucaccuuccgcaucccuuacuacgugggcccccuggcccggggcaagucugacuucgcguggcugucacgcaagagcgccgacaagauaaccccuuggaacuucgaugagauuguagacaaagagagcuccgccgaggccuucaucaaccggaugaccaacuaugaucuguaccucccgaaccagaagguguuaccaaagcacagccugcucuacgagaaguucacgguguacaacgagcugaccaaggucaaguacaagacugagcaagggaagaccgccuucuuugacgcgaacaugaagcaggagauauucgacggcguuuucaaggucuaucgcaagguaacgaaggacaagcugauggacuuccucgaaaaggaguucgacgaguuccggaucguugaucugaccggccuggacaaggaaaacaaagccuucaacgcauccuauggcaccuaccacgaucuccgcaagauucuggacaaggacuucuuagacaacagcaagaacgagaaaauccucgaggacauagugcugacccugacccucuuugaggaccgggagaugauccguaaacggcucgagaacuacuccgaccugcucaccaaggagcaagugaagaaacuugagcgccgucacuacaccggcuggggccgccugagcgcagagcucauccacgggaucaggaacaaggaaucccgcaagaccauccuggacuaccugauagacgacggcaacagcaaccgcaacuucaugcagcucaucaacgaugacgcgcugagcuucaaggaagagaucgccaaggcgcaagugaucggggaaacggauaaccugaaccaaguggugagcgacaucgccggcagcccggccaucaaaaaggguauccuucagagccuuaagaucguggacgaacugguuaagaucauggggcaccagcccgaaaacaucgugguggagauggcucgggagaaucaguucaccaaccagggucgccgcaauucccagcagcggcugaaaggauuaaccgacagcauuaaggaguucggaagccagauccugaaggaacacccgguugagaacucgcagcuccagaaugaccgacuguuucuguacuaccuccagaacgggcgcgacauguauaccggcgaggagcuggacaucgacuaucugagccaguacgauaucgaccacaucaucccccaggccuucaucaaggacaauaguaucgacaaccgcgugcucacgagcuccaaagagaaccgcggaaagagcgacgacgugcccuccgaagacgucgugaaccgcaugcgccccuuuuggaacaaguuguuaaguuccggccugaucagccagcggaaauacaacaaccugacgaagaaggagcugaccccggacgacaaggccggguucaucaagcgccagcucguggagacccgccagaucaccaaacacgucgcccguauguuagaugagcgguucaacaaggaguucgacgauaacaacaagcgcaucaggcgcgugaagauugugacuuugaaauccaaccucgucagcucguuccggaaggaguucgagcuguacaagguucgcgagauuaacgacuaccaccaugcccacgaugcguacuugaacgccguugucgucaaggcccuccuggucaaguaccccaagcuagagcccgaguuugucuacggggaauauccaaaguacaacagcuaccgggagcgcaaaaccgcuacccagaagauguucuucuacuccaauauaaugaacauguucaagagcaagguaaagcucgccgacgaccagauuguggagcgaccuaugauagagguuaacgacgagaccggcgagauagcgugggacaagacgaagcacaucaccaccgugaagaaggugcuguccuacccccaggucaacauagugaagaagguggaggagcagaccaucggccagaacgggggccuguucgacgacaaccccaagucuccccucgaggucaucccgagcaagcuagugccccugaagaaggcccucaaccccgaaaaguaugguggcuaccagaagccgacgaccgcguaccccauccuacugaucguggacaccaagcagcucauccccaucuccgucauggacaaaaagcgguucgagcaaaauccagugaaguuccugaaggacaaaggguaccagcaaaucgagaaaaacaacuucgugaagcugccgaaguacacacucgucgacaucgguaaugguaucaaacgcuuaugggccagcuccaaagaggugcacaaggggaaccagcuggucguaagcaagaagucacaggaccuccucuaucacgcgcaccaccuggauaacgauuacagcaacgaguacguaaagaaccauuaucagcaguucgacauccucuucaacgagauaacguccuucaguaagaagugcaagcugggcaaggagcacauccagaagaucgaggaggcuuacuccaaagaaagggacucagccuccauagaggagcuugcggauggguucauaaagcugcugggauucacacagcugggggccacgagccccuucuccuuccucggcaucaagcugaaccagaagcaauacaccggcaagaaggacuaccugcuccccugcauggaggcgacgcugauacaccaauccauaaccgggcuguacgagacccgcauugaccuaaguaagcugggcggggacuga

SEQ ID NO: 7664 - RNA, 4053 nt, Artificial Sequence; identical to SEQ ID NO: 1864
  Cas9 variant

SEQ ID NO: 7665 - RNA, 4053 nt, Artificial Sequence; identical to SEQ ID NO: 1865
  Cas9 variant

SEQ ID NO: 7666 - RNA, 4053 nt, Artificial Sequence
  Cas9 variant
augaagcguauccugggccucgaccuggggaccgccagcaucggcugggcccuggugaacgaguccgagaaugagaaggaaaaguccgagauuaucaagcucgggguccgggugaacccccugaccacggacgagcagacggacuucgagaagggccgcccguuauccgugaacgcggaccggacccucaagcgcggggcgcggcgcaaccugcagcgguucaagcagcgccggaagaaucugaucgaaauccucaucaagaagggcuucaucacuaacaucagcuuacugacggagaucggcuccaacaccaccuaccagacccucgagcugcgcgccaagagcgucaaggagaagaucgagaaggaggaguucgcccgggugcugcucacgaucaacaaaaagcggggguacaaguccagccggaaggccaagaacgacgaggagggcucccugaucgacgggaugagcguugcgaaggagcucuacgacaacaaccucaccgucggccaguacguguaccagcuucuggagaagggcgggaaguacauccccgacuucuaccgcuccgaccuccagaacgaguucgacgugaucuggaacuuccagaaggaguucuaccccaacauccugaccggcgagcuguacaagaagcuccaggggcaaggccagcagaacagccggaagcuguuccuggcuauccaccagaucuacaccgccgagaacaaggggaagcgcgacacggucaagaagcagcacuacaaguggcggaacgacgccaucaacacccagcuccugaucgaggaaguggcguacgugcuggucgagaucaacaacaaccucaacaaguccagcggcuaccugggcgccaucuccgaccgcagcaaggagcuguacuucaacaaggagaccgugggggagaaccuauacaagcagauccaggagaacccccagaccucccugaagaaccagguguucuaccggcaggacuaccuggacgaguucgaacagaucugggagacgcaggccaaguucuacagcgagcucacuaaggagcugaaggaggagguccgcgauguggugaucuucuaccagcggaagcugaagucccagaagcaccucaucagcgagugcgaguucgagaagcaccacaaggccauccccaagagcagcccccuuuuccaggaguucaagauauggcagauccugaacaacaucgaguucaagcacaagaagaccaaggagcucaagauccugagcgaggagcugaaggagacacucuucgaggagcugaacauccgcggcaacuucacguccgacgccguccugaaguucgugaagcucgacaagaaggagugggagcugaacuacaagaaggggaucgagggcaaccgcaccaacgaggugcuguacaacgucuaccagaagaucgcggaguacgagggguacggcuucgacuggagcaagaaguccgccguggagaucaaggaggagcugaacaccaucuucagcgagaucgguauuaacuccaagauccucgacuucaaccccgagaucagcggaaacgacuuugacaagcaggaauccuaccagcuauggcaccuccucuacagcgccgaggaggacggcuuccugaagcagaagcugcaggacaaguacggguucaaguccgaguacgcuaacaugcucgccaacgugagcuuccaguccgacuacggcagccuguccgcgcgggccaucaagaagauccuucccaaccuaaucgccgggcacgaguucagcgaggccugcucccugagcggcuacaaccacaguaacagccugaccaaggaggagcucgccaaccggccacugaagggcaagcuggagcuccugaagaagaacagccugcggaaccccgucguggagaagauccucaaccagauggucaaccuggugaaccagguuaucgaguccuacggggagaucgacgagguucgaaucgagcuggcgcgggagcucaagaaguccgcccaggagcgcgcccucaugacgaccaacaucaacgccagcaagaccaaguacgagagcuuccggaagcugcuccagaaggacuucggcaucaagaaccccacccgcaacgacaucaucaaguaccggcuguacgaggagcugaaggccaacaaauaccacacgaucuacaccaacaaauacaucccccgcgacaagcuguucuccaaggaaaucgacaucgaacacaucaucccgaaggcgaaacuuuucgacgacagcuucuccaacaagacccuggccuuccggaagcccaaccaggacaaggggaacaugaccgccaucgacuacauccucagcuaccagucgaaggacaucgacaacuacaagagccggaucgagaaccuguucaagaacggcaagggggacaucucuaaggccaagcggaacaagcugcucauggaggagaaggacauccccgacggcuucaucgaccgcgaccugcggaacagccaguacaucgcgaagaaggccaagcagcugcucgaggaggugauccgcacggugaacacuaccaccggcuccguuacuaacaagcugcgggacgacugggggcugaucaacgugaugcaggagcucaacaugcccaaguucaaggccaucgacgagagccugaucgagcagaucgagaagaaggacggcaccuucaagacccgaauuaaggacuggagcaagcggaacgaccaccgccaccacgccauggacgcccugaccguggcguucacccgcuacaaccauauccaguaccucaacaaccugaacgccaagagcgacaagaagggggccaucuacggcauccaggagcuggagacguacgucaacuccaaggguaagcggaaguucaucaagccgaugcacaacuuccgcgaggaggccaagaagcacaucgaggacauccucaucucguucaaggccaagaacaagguggugaccaagaacaucaacaagauaaagagcaaggacggguucaucaagaaaguccagcugaccccgcggggccagcugcacaaggagaccguuuacgggaagaucaacgaggucguagugaaggaggagaagaucaacgcgaaauucgaccucgagaagaucaacaaggugacgaagcccaucuaccgcaacgcccugcugaaacggcuucaggaguucaauggcgagcccaagaaggccuucaccgggaagaacucccugagcaagaacccgaucuaccuggacgucgcccagaccaaaacccuccccgaauccguuaaggugcaguucuucgaggagaacuacacgauccgcaaggagaucagccccgaucugaagaucgacaagaucaucgacaagggcauccagcggauccugcucaagcgccuggacgaguucaacggcaagcccaaggaggccuucuccaaccuggagaagaaccccaucuggcucaacaaggagaaggggaucgcgauuaagcgggucaagauaaagggcgugaagaacguggagagccugcacaacaagcgcgaccaccuggggaacgagauccuccagaagggcaaauccgcucccaacgacuacgucagcaccgggaacaaccaccacguggccaucuaccaggacaagaacgggaagcugcaggagaagguggucuccuucuacgaggccguggcgcgggugaacaacaagcugcccaucaucgaccaggacuucaacaaggaccucggcuggaaguuccuguucaccaugaaacagaacgagauguucgucuuccccagcgaagacuucaagccgcuggagaccgaccucauggacaagaagaacaacaguaagaucagcaagaaccuguuccgcgugcagaagcuagggaacaaggacuacacguucaggcaccaccucgagaccaagaucgaggacaucaagaagcugcgcgacuucaccuacauccggaagcgcaaccccgaguccaucaagaacaucaucaaggugcggaucaaccaccugggcaacaucguccacgugggggaguacuga

SEQ ID NO: 7667 - RNA, 4056 nt, Artificial Sequence
  Cas9 variant
augagcaagaaguacuaccugggccucgacaucgggaccaacuccgugggcugggccgucaccgacgagaacuacaaccugugcaaguacgccgggaagcgcauguggggcauccggcuauucgagggcggggagacggcggagcagcgccggaucagccgcuccaaccggcgccggcucagccgcaagaagcagcggaucgaccugcugcaggaacuguucgccgaagagaucgccaagauggaccccaccuucuucauccgccugaacgagucgcggcugcaccucgaggacaagagcaccggcgagaaguucccacuguuccgcgacaaggacuacaccgacauccaguacuacaaggaauaccccacgauguaccaccuccggaaggagcucaucgagaacuccaaggugcacgacauccgccugguguaccuggccugccaccacaucuuaaagaaccgggggcacuucuuaaucaacggcagcuucuccgacgucaagaagcugagcuccgugugcgagagcaugcucaacuccuucaacgggaucagcaaguaccagaucgagaucaacgacaucgagcgccuggaggagauccuguccgaccggaagaagcagaaguccgugaaggccaaggagcucauccagaucuucgagugcggccccugcgaggacaagaccgacgagaagaccugcaaggcgauagucagcaaccugugcaaguggcugaccgggcucaagggcaacaucaacagcaucuucgacaugcaauucgaggagaucgacacguccagcuucagcuucaccgagcccaaguacgaggacaccaucuccgccgcccuggaggagaaauacccggauuacgccgacgugauccagaagaucaaggcgguguacgacuggagcguccuggucgagaucauggccggcgaggacuaccucuccuucgccaaggugaacgccuacaacaagcacaaggagaaccugugcauccuaaaggaggucauccgcaaguacugcgacagugagaucuaccacaaguuuuucaacggguucgacgagaagaacggcuacgggaacuacaucggcuccaucuacaagaacggccacagcuacgccaugaagaagugcuccaccgaagauuucuacaagacgcucggaaagauccuggacaagauccagcccgagaaggaggacgagaacgugcuggaggagcucaagguggaggucaagaaccagacccuccugccccucgcgcggaccaccgccaacggcacgauccccaaccaggugcacauccaggagcugcgcgccauccuggacaacgccaagaaguaccucccguuccuaaacgaggaggacgaguacgguaccguggcugagaagaucaucagcaucgcgaaguuccggauccccuacuacgucggcccccuguccacccgccacaaggagcagggggccaacagcuggaucgugcguaagcaggaaggccggaucuaccccuggaacuucgaggagaugguggaccucgagcagaguaacaaggaguucauccagcgcaugaccaacaagugcacguaccugaucggcgaagacguccugcccaagaacagccuccuguacucccgguacauggugcugaacgagcucaacaaccugcgcauccgggguaacaagaucagcgugaaacugaagcaggagcuguauaaggagcuguucugcaccaaggccaaggucaccggcaagggccucuucaacuaccuaaagaaggaggacgaggagcucgcccuggaggacaucagcggguucgacaucgacuuuaagagcucccugaccucguaccucgacuucaagaagcagauacugggggaggagaucgagaaggacaaguacaagggcaucguggagaacaucaucaaguggaagacgaucuacgacgacgacuccaagaugaugaagaagaugaucgagcgcgaguacccaaacgucuucagcaaggacaagaucaagaagaucugccgauucaaguacagcggcugggggaacuucucccugagcuuccucaacggcauccgcggggccgaccgggagaccggcgagagcuucaccaucaucgaggcgcuguggaagaccaacuacaaccugaugcagcuccugagcaagcaguucacguuccgcgaggagaucgaccugaucaacgccgagaagguggggaagaucaauaagguguccuacgacaacaccgucaaggaccucaucgugagccccgccaacaagcgggccaucuggcagaccgugcagaucaccgaggagaucaagaaggucaugaagugcgagcccgagcgcaucuucaucgagauggcucggggcggcgagaaggagaagaagcgcacagugucccggaaggcgcgccugcucgagcucuacgccgccugcaaggacgacgugcgggacuggaccaaggagauagaggaccgcgaggagcgggaguucaacagcaagaagcuguaccuguacuacacccagauggggcgcugcauguacuccggcgaggagaucaacaucgacgagcucaugcagaagaacagcaagugggauaucgaccacaucuacccgcaguccaagaucaaggacgacagccuggacaacaugguccuggccaagaaggugauaaacaacuccaagcagaacaagcuacugagcuccgacauccgcauaaagaugaagaaguacuggaacgcgcuguacaaggggaacuucaucagcaagaagaaguacgaccggcucacccgcacggaggacuucaccaacgaggagcuguccggcuucaucgagcggcagaucguggagacccgccagagcagcaaggccgucgccgagcugcucaaccggcuguacgagcacuccgagaucguguacgugaaggccggccuggucagcgacuuccgccacgacaacaaguuacugaagucccggcgcaucaacgacuaccaccacgccaaggacgcguuccugaacaucguggugggcaacgucuacaacgccaaguuuaccagcaacccccggaaguggaucaaggagaaccgcggcaccaacuacuccauucggcgcguguucgacuacaacgugaagcgggggaacacggucguguggcagggcguggaggacgggggucacagcaucgacgagauccgcaagaccauggcccggaacgacauccucuacacagaguacaccuacugcgacaaaggcgagcuguucaacgccacgcugaucaagaagggaaacgacaaggccaucaaccucaagaaggcgcuggacuccgucaaguacggcggguacaacucgcccaagaccuccgccuucgcguucaucgaguucgacggcaagaagaaggagcgcaagaaccacaucguggagauccccguguacaucgucaacaucgccaagcggcagccggacaccauaaaggaguaccuggagcagaagaagggguacaagaaugugguggucaagaaguaccccaucaagaagaacgcccucaucaagaucgacggcuaccuggcgcgccuccggggcgccaacgagaccgacauccuccugaagaacgccgugcagcugauccucaacgacaaguacuacgagaucauucgccggguggagaaguaccuggaguacaacguccgcuacgaggccgagagcauguucgagggguucgaccacgcggaccugaacucccucuacgacgagcugacgagcaagcuggagaccuccaucuacaagaagcgccccgccaaccagcucaacgcccuggagaagggcaaggagaaguucaagaacauccagacccugcgggagaaagcccagaucaucaaggagaugcucaucauguaccgcugcgaugccgcgaccguggccaaccugaaggccauugggggcagcgccaacgccggguccaugaagaucaagaagaacacgcugaccagccggucccucguguuggucaaccaaagcaucaccggccuguucgagaccgaggaggagcucgucuga

SEQ ID NO: 7668 - RNA, 4056 nt, Artificial Sequence
  Cas9 variant
auguauaagaaauacggaauaggccucgauaucgguacaucaucaaucggguggucagugguugacgaauacggucacaucauccguguaaaaggccagaccggucuaggcguucgccuauuccgcgaaggccagccugcagcagacaggcgcacuuuccgcacuacccgacgccggcucggucgccgucgauggcgccuccgacuccuccgggaaauauuugacccauacaucgcagcacaggacccuaacuuuuucgcccgccaaaaggcaagcgcaaucgcccccggagacucccgguucaaagccgucuaccgguuguucaacgaccagacggaccgacaauucuacgacaaauauccaaccguauaccaucugcgacagaaacuaaugacagaaaagcgccaauucgacaucagagagaucuaccuagccgugcaccacaucgucaaguaccgcggacacuuccucaccggcggagcggccaagaacuucaaaccggguaaacuugaccuaaacaccuacuucgccaccaucaacgcccagcuagccgccaucuucauggacucgcagguagaacuuccccagcucgacugggacgccgucgucagccuccucacgaacgaccaagagucacccucugaucgccaaaaagcccugaccaagaugcuaguggcacaaggagacgccacccaaaaacgcuucuacacggaguucagcaaagcccuacucggcuuaaaagcgaagcuauacguccucaccggcuucgaaggcgacaaaacggaucagaaagcacuaacacucuccuuagagacgcuagacgaccaccaagacgauguaacgcaacuccuaggcgacgagcaaagacaacucgucgaacuccuagccagaguacagagcgcaauccagcucgccauaaucaucccaaauggaaaaacguucuccggccaaaugguacaacaauaccaaacacacuacgaccaacuacgccuccuaaaagacuaccgcgaacaacuaacugaucagaaacacaggcgagcgcuaaaacaagccuacgccgacuaccuggcuaacgaccaggaucaagacgcgcuggucaaggcugucgaaaaaguucucaaacaaaaccagccccucuccacagucggcgucagguuacaaaccgccauagacgccggcgacuuccuuccgaaacaacgcacaaaagccaacaguguaaucccgcaucaaauacaccaacaagaauuagaccgcauaauagaagcccagucggucuacuaccccuggcuagccgaagaaaaccccguggcagcccaucgaucauacgccccauacaaacuggacgagcucgucgacuucagaguuccauacuacguaggcccacuuguacaaccccaggccgauaaggccgcaaaagaaaccaaguucgcauggaugacgcgcaaagaggcacaguccacgacaccaauaacaccauggaacuucgaacaagagguggacaggaacgcaucagcaaacgcuuuuauccaacgaaugaaaacaacugauacauaccuccuaggggaggacguccugccuaaaaacucucuacucuaccaacgguuugaagucuuaaaugaacuaaacaacguucgggucgacggcaaacuccuaaccaucgcagaaaaacagcgccuuuuccaagaccuauucgucgauagaagccaggcuuccgucaccauagcacagcugcaggcaaaccuaauagcccacggggccgcgaaggaccgcguugaaaucaagggccucgccgaccccaagcgauuccuauccucgcuaacaaccuaccacgacuacgcacaaauaauucccgaagcgcucgagcaaccagacaagcgcgcggacaucgagaaaaucauaaacuggagcaccaucuucgaagauacuucaaucuucaaagaaaaacuucaagaaaucgccuggcuuacaccagaccaacgacgccaacucagucagaaaagguaccgaggauggggacaacugucugacaaacuccucacccaauuacgcgacgcgacuggccaauccguuauggaccugcucuggacggaaccaaacaacuucaugcaaaucauccgccgaacggaguuccaacaagcaauagcgagagucaaccaaacggaccuuaagcaacaggaccucgcaaccacaauuaacgaccucuacacaagcccccaaaacaaaaaggcuauccgacaaguccuccucgucgucgccgacauacaaacugccaugcaugaagucgcacccagcuggcuguucauagaagccgcuagaggacccgaacaaaaucccaagcgcaaacucgcccgacaacaacagcuauuagaagcauacaagaccagcgcuaaagaaaucguaaacgaagccgucaaagagaaacuccuauccgccauagaugaccaccaaaaauuugaggaccaagucguccucuacuuucaacaaaacggccuagauauguacaccggcaaaccacucgacuucgaacgacuauccaaauaccacauugaccacauuaucccacagucugucgucaaggacgacagccucgauaauagaguccuaaccacaccggaagaaaacgaacgcaaaggagcccguguuccuggcccacuuuacgcuucccaacagggccgcuggcggcuucugcagcgggccggccucauaucacaacgcaagcucgaccaccuacuauugcgccccgaagaacucgaccaacaggccaccggauucgucgccaggcaguugguagaaacaagacaagucaucaaacuuaucacaaauauccucucccagcaguacgacccagaacagaccaagcuaguguccguaaaagcaggccugagccaccaauuccggacccgccucaaccugcccaagcuccgggaacucaacgacuaccaccacgcacacgaugccuaccucgccgcccgaaucggcacauaccuucuccaacgcuacccgaaccuugaacgguucuucguauacggccaauaccaaaagacucgauuugaccugaaacgacacuucaacuucauuggggagaugcucaagggcaaacccgaggacgccguaauagucaaggccccucacagcgaaaccguaaucugggauaaacaagacgaaguuaagcagcuaaagaaaaucauggaauaucgccaucuccucgugacacaugagguguaugacaaucacggagcccuuuucaaccaaacaauacacccugccaaaaaccccaaaaacagaaaacuaaucccgcguaaaaccacccaaaguaccgaacucuacgggggcuacucuggugaaacaaccggcuaccuagccaucgcacggaccgugaccaaaaacaaaauaaguuaucaaguccuccgcguccccacacgacuugugggaaggcuacaacgcucaagcgaaucugcccaaagacagauuuuaacugacugguucgcccccucguucguaucccgcggaaaacaacagccuuucgagauaguccuccgucacgucuucaaaaaccaaacagucaucgacgacauccacgaacaaagccaccgcuucgggcugagguccgacacauacuauuguaaccaacaacaauuaguccuaucccucgaacaacagcgaaugaucaucgaccagaaacuuaacaacacaaacaaacuuauggucguguacgaagccgugugcgaucagguagccaaguacuuucccuuauaccgcaugaaccacuuuaaagaaucacuacuugaagcuggaccaaaacucgcagaacuacccauaaacacgguacaauccaaaaacggcaaguuaaaacugggucagcguucagugcuccuccaaaccaugcaaggccuucacgcaaaccccgaaaccaaagacuugagcaucaucggcugccccaaguacuucggaaaacuccagguauccagcggaaucaaacucaccgagaacgcuguacucauccacgaguccccaaccggccucuuccagcgccgcguacggcucagcgaccucuga

SEQ ID NO: 7669 - RNA, 4056 nt, Artificial Sequence
  Cas9 variant
augaagauacuaggccucgacuuaggcaccaacucaauuggaugggccguugucaacgaggcagaaaacgaaagggagucuuccaguaucauaagacucggaguaaggguaaauccacuaaccguggacgaacaaaacaacuucgaaaaaggaaaaccaaucacgaccaacgccgaccgcacccugaaacggagcaugcgccgcaaccuacagcgguacaaacugaggagagccaaccuaguaucccuccucaagacccaaggcuggauaaccgacgagacgcuccucagcgaacaaggaaacaacuccacuuucgaaacguaccgacuacgugcggaggcagccacuaaagaaaucacauuggaacaauucgcacgcguccugcuaaugcuuaacaagaaacgaggcuacaaaucuagccgaaaaaugaaacacgacgaagacggaucauucgucaacaaccucgacauugcaagggaacucuacgacucuggacugacacccggacaauacgccuacaaccuccucaaagauggaaagaaauacauaccagacuucuacagaucggaccuucaggaagaacucgauaaaaucugggcauaucaauacgaauaccacgaaaauauccucacccacucgcuaagguccgcgaucaucgaucagagcaaaaccgggacaaccaagaucuuccucaaaacccacggaauuuuuaccgcagacauaaagggcaaucgcaacgaacgcaacaagcagcuguucgaacugagguguggugcacuggaacgagcgcucaccgcggaggaacucgcaacugugaucgcggaagucaacggacagaucaacucguccuccggguaccugggggccauuucagaccgaagcaaagcccuauucaucaaccaucaaaccgucggccaauaccuaaugcaacagcuagaccgggaccccaacaaaucacucaagaaccaaccguucuaccgccaggacuaucuagacgaauuugaacaacucugggaaacccaagcucacuaccacccugaacucaccgccgcccucaagcacgaaaucagggacauaaucauauucuaccaaagacgucugaaaagccaaaaauggcucguggccaacugccccuucgagcaccgcaaaguaugcccaaaauccagcccgcuguuccaacacuuuagaauauggcaagugcucaacaacgucaccgucaccgucgacaacaaaacguacguacugaacgaagaacaaaaaucaauacucagcaaagagcuccuauacaaggaaaagauauccaaacgcgaugcguuaaaaauguuauucgugaaagcgaagggcguagacaugaacuucgccucgcuggaaggcgaccguacaaugagcaaccuacucaaggcggcgcaggaaaucguaucaaucaguggccacggcgauuacgacuucgggaaaaugcccgcagacgacauacacaauaucauacggagcgucuucggaggucuaggauucgcgaccgacuggcucaaccuugacacggacgcggacgaccucgaacaagagucgcaaaugcgucuguggcaccuaauuuacucauucgaaggggacaauuccaccaccggcgacaccaagcucgucgaacgcuuaaugucccuccucaacuuaccccaggaguacgcaagacucuucgccaacgugcaucucgaagacgacuacugcggaaucuccuccaaagcccuaaagcguauacuacccuuuaugaaagcaggccacauauacucggaagcaugcgcacuugccggauacaagcacagugaacaaucacugacaagagaggagaacaagaaccguccgcugaaagaccaccuugaacaacugcccaaaaacucccugcgaaacccaguagucgagaagauccugaaccaaaugguaaauguagucaacagcaucaucgacaccuacggccgcccugacgaaauccgcauagagcucgcccgcgaacucaaaaacaacgcacucggacgccaagccauuuucgaagccauuaaccgaaacaccaaggaaucagaacgcauccagcaaauacucaagaaagaguucggccuuacgcacguaagccggaacgacauaauccgguaccgacuauaccaagaacucuccggcaacggcuacaaaacgcucuacagcaacauuuacaucccacaagaaaaacuauucucaaaagaaauagacaucgaacauauuaucccucaagcacgacucuucgacgacagcuucagcaacaagacgcucgaauaccgggacgugaacauaaagaaaucaaauacaaccgccauagacuucgucaggaaugaauacggcgaaaacgaagucgaacaauacaaaaagagggugaaugacuuacucaagagcggggccauuucccaggccaaagccaaaaagcuaaaaaugaccgaagcagagaucccuaacgacuucaucgaacgcgaccuacgcaacacacaguacauaucccgcaaggcccaggaaaugcugcgagacguggcaagagugguuaccgcaacaacggggucugucacggaucgccuacggcaagacuggcaacucgucgacguuaugcaggagcucaacugggacaaguacgaaagacaaggccuuacaacagugauaaauggcagagacggacaacagauccgcagaaucacagacuggacgaaacgcaacgaucaccgacaccacgccauggacgcccucacaaucgcauucaccaaacccgcauacaucuccuaccucaaucaccuaaacgccagguccgaagacgacauccguagcauugaaaggcgauuccuagagcgagacgcgaacggacaucuaagauucauuagcccaauugcacacaacuuccgaucugaagcuaaaagacaccuagagaugauccuaguaucaauaaaggccaaaaauaaggucguuacaagaaacaauaacacaaccaaaaccaagggaggcagacgaaaccggauccaacucacaccacggggacagcuacaugacgccacaguauacgggaguauucuccuaccacacacaaagaccauagccguagacggcaaaaugaccgccgaaaucauaggucaaguacaaaacccagucuuccgccaagcccucagccaaagacuugaagccugcggaaacgaucccaaaaaggcauucaccgguaaaaacagccuagaaaaagcccccguauggaucgaccaagcacacacugaacaugucccggcagaaguaacaauccaacgcuuggaaccucagcacaccauccgacgggcggugaacaaggaccucaauaucaacaaaguccuggacaaaggaauccagcacauacuucaagcgcgccucgacgcuuacggcggcgacgcagccaaagcauucgccaaccuggacaacaaccccauauggcucaaccaagagaaaggcauagccaucaaacgcgucaccaccgcagaaaacaucuccggagaaccccuacaucacaagcacgauaaggagggcagaccaauccuggacacgaacggcaaacccaugcccagcgacuucguccgccucaugaacaaccaccaugucgccauauuucaagacgccgacggcaaccuccaagaacacaucguuagcuucuacgaagcgguagcccgagucacugaacucgggcucccgguaaucgacaaagaauacaauaaagacaaaggauggcaauucuuauucacacuaaaacagaacgaauacuucguauucccgaaucccgcacaaggauucaaccccgacgagaucgaccucacggacgagcgcaauuacagcagaauaucaccgaacuuguaccgagugcagaaaaugucaagcaaauacuacguauuccgccaccaucucgaaacaacaguggaagauaagaaggagcuucaaggcauuacauggaaacgcauacaaagccucaacaaccugaaagguauuguaaaggucaggauagaccacauaggacgcauaguacaaauaggggaguacuga

SEQ ID NO: 7670 - RNA, 4056 nt, Artificial Sequence
  Cas9 variant
auguucagccagcagaacaaccuguauugcgagucccuaagcaagcuguacuacaauauuaccaagaacuuucuguccaagaacgaggugugccgcaucuacgagauauucuucugcagcauccucaccuacuuccugaaaaaguacaaccacgacaucuucaagaaguccagcacgaugaaaacgauccugggccucgaccugggggucaccuccaucggcugggccgugaucgugaccgacgacgacaauacgcccaucaagauccuggggauggguagccggaucaucccgcucuccaccgccgacaaagaggaguuccagaaggggcaggcgaucucaaagaaccaaucccgcaccaucgcccggacccagagaaagggauauaaccgaaagcagcugcgcaaggaggagcuaaagaaaauccucggggagcuggggaucacgcccaguaaggagcugcuuaaccugccaucgaucgagcuguggaagcuccgggccgacgccgccagcggcaacgcgccccuguccgccgagcagcuggggcgcaucuucuacaugcucaaccagaaacggggcuacaagagcgcgcgcuccgaggccaaccaggacaagaaggacaccgacuacgucgcggccgugaaggggcggcaccagcagcugaaggagaagggccagaccaucggccaacauuuuuacaccgaaaugcugacgcucgaggaaaacagcggccacuuccaggugaagaacaacgucuacccgcgcgaagcauaccuagaggaguucaacgccaucaucgccgcgcagaagccccagcacgccuuccugaccgacgacgugguggaccggcuccgcgacgaggucaucuucuaucagcggaagcugaagucccagaagggccuggugagcaucugcgaguucgaggguuucgagcgcaccuucuucgacaaugugaagcagaaagacaagaccaucuucacgggccccaaggucgcccccaagagcuccccacuguuccagcugugcaagaucugggagaccgugaacaacaucaaccugaaggugaagaacaccgacggcagcaaaaacaagugggccgacuacguccccacccucgagcagaagcaagagauaaucgagcaccuguucaagaacgccgggaucucccuggacgcccuccggaagauccugggauucaauaaggacgagaucuuugugaacaagcagauagagaagggacugcagggcaacacgaccuaugccgagauccacaagauucucggggacagcaagcccgagcugcugggcuucaacauaaacaucgagcccuccaagcacagugcccuccugguggacaagcgcaccggugagauccuggccgagaaggaggggcagcaagucuccgcagagaucgagaaggagaacuucuaccagcucuggcacaccaucuacagcaucaaggaucuggacgagugcgcggccgcccugaucaagcgguucaacaucgacccuaacguggccgcccagcuggcgaagaucgacuucuccaagggcgccuucgggaacaagagcaacaaggccaugcgaaagauacugcccuaccugaugcagggguacaacuacgccgacgcguguucccuggccggguacaaccacagcgacucccagacuaagaaagagaaggaagagaacguggucgacgacaagcucaaguugcuagagaagaauagccuccggcagcccgugguggagaagaucaucaaccagaugauccacgucgugaacgcaaucauugauaaguacggcaaacccgacgagauccgcgucgagcuugcccgcgaccugaagaaguccaaggaugagcggaacgaggccgagcuccagaacgcgucuaacaagaagcugaacgaggagguggccaaccgccugaaggagcucggccugccggugaccaagcgguucguccaaaaguauaaguucaucuuccccgugcgcgacaggaagaucaaggaggcccagcuggugaaccagugcauauacuguggggagaccuucaacgucaccgaggcccucuccggcgauaacuucgacguagaccacaucauccccaaaagcaugcuguucgacgacucccagacgaacaaggugcugguccaccgcaagugcaacgcgaaagacaagagcaacaagaccgcguacgacuucaucgccgccaagggugagaacgagcucgccaucuaccuggaccggguggacgacugguucaagcgcggcgugcugagcuacgggaagaugcagcggcucaaggucuccuacgagcaguacgccgagcgcaagcagcugaagaaggagaccgaggcggacaucaagcugugggagaacuucaucgagcgcgaccuccgacagacccaguacaucgccaagaaguccaaggaccugcuuaagaagaucugcaacaacgugacggugaccgagggaaagaucaccgcccagcuccggaaucuguggggcugggaugacguccugaugaaccuccaguuacccaaguacaaggcccuggggcagaccgagaucaaggaguggacuagcgagcacggccgccggcuccacaagaaggaggagaucacuaacuggaccaagcgcgaugaccaccggcaucacgcaaucgaugcccucgugguggccugcaccaagcagggguuuauccagcgcaucaacacccugaacagcuccgacacgaaggaugccauggacagagagauuaaggccgcgaaggagaaguacaacgagcucuacgacaagaagcugcugaccgagaccaacgagcaggucaagaaccacaccgagcguuucaacaagcucgaaacguaccucaaaagccagcagccgccccuguucaccacccgcuacguagaacaggaggccgacaagaucuucguguccuucaaggcgggcaagaaagccgcgaccuacggcauccggaagaucaagaaagacgggaagaaggucguggugcaggagaagaucgucgugccccgcggcgcgcuccacgagcagagcguguacgggaagaucaagacgcaggagaaggauaagccucugaaguacuuguuugagaacccggagaccaucguagacaaccggaucaagauucucgugaaggagcgccuggacaaguucgaaggcgaugugaagaaggcccugacaucccucaagaaggagccccuguucaucgacaacgagaagaauacccuccucgagaaggccgccugcuacacggacgcaaccguccugaaguacaaacugcaggcgcucaaggccaaccaggugaacgauaucguggaugagggggucaagcggaucgugaaggcccgauuagcccagcacaaaaacgagaaggaggcguucaaggacaccgugugguucaaccaggagaagcggauccccaucgucuccguccgcguguucgcccggcccgacgccuccaagcuggccaucaucaagaccgacgagaacaacaagccgaucggcuucgcccucacgggcaacaaucaccacauugcgaucuacaaggacaacaccgggaagcugguccagcacaucugcaccuucuggagcgccguagagcgcaagaaguucggagugcccaccgucgugaagaacacggggacgcugugguccgagcuccugcacaaggaccugcccggcaccuuccucgacaagcugccgcaggaugggcuggaguuggaauacagccugcagcagaacgagauguucgugcuggggcucccaaaagaguccuucgaggacgccaucaagaacaaugaccucccccugcucagcaagcaccuguaccuggucugguccaucagcgacaacgacuacugguuccggcaccacuuggagaccaagaacagcgagcugaaguccacgaccggcgccaaggagagcaagcgcuacuaccgguuccaguccguggggaccuucacuaaggagaaccccaucaaggugcagcugaaccaccucggcgagaucacuaagaucggggagccguga

SEQ ID NO: 7671 - RNA, 4059 nt, Artificial Sequence
  Cas9 variant
augaagaagcgcaaccgugaggaguacuacgugggccuggacaucggaaccagcuccgucggcugggccgucgcaacccccgacuaucgcauuccgaaguuccgggggcacaagauguggggcagcagguuguucgcggaagggaagcgggccgccgaacgccggcaguuccgcacgaaccggcgccggcucgcccgucggcgcgaccgguuacagauccucgaggagcucuuugccgaggagauggcgaagguggacaauaccuucuucaugcgccugaaggagaguaaguucuuccucgaggacaagacagucaaggagaagcacauccuguucagcacagacaaguucgacgccgaccgguuuuacaaggacaaccccacgaucuaucacgugcgcaaaaggcugauggaggaggaaccccaagacauccgagagcuguuccucgcggugcaccauauccugaaguaccggggccacuuuuuguuugccggcucccuggagcagaacggggcgagcaucgaggagcugguccgcacccuccugggcaagcaggggcuugccauccuugacgauacaauugacucaaacgagauggucaacauccugaagaacaccggcgagaccaagagcgaccgcaagaaggacguucaagagcuguggaacccccucaaggacaaggucaagaaggcacaagccgccgagauggcgggccuggugcugggccucaaguccgacaucagcaaacucuucgccaacuccgacuacaaggaccuggacagcuccauaaagaacauuaacuucagcaguggagacuacgaggagaagcgggacgacuacgcgaacagcaucggugacgacauagugcuauuggauaccaugaaggcucuguacgacacacucauccugagccagauccugcaggggaagcgcagcaucagugccgcgaaggucgaggacuacaacacccacaaggagcagcuccgcgcccugaaggccauccugaagccgcacaagcgccucuacaacgagauguuccgcgagaacaacaagaaggaccugagcaacuauguugccuacaucagcuccuacagcgaggggaagcgcgugaaccgggagggcuucuacaaguacguucaggccgugcugaagcaggucgacgacuccgacagcaagcaggcgauccuggaggcuaucagacuagagacuuuccugcccuuacugcggguuaaggacaacgccgugaucccccaccagauccaccaggccgagcuggaggccauccucgagaccgcgcgcaagaaguacaacuuccuaaacgacgucuccgacggcgucagcgugaaggacaagaucauucagcuguuuacauuccggaucccauacuacguggggccucucaacccccacuccggcgagacggucgccgaccgcaagcaggggaccgguugggugguccggaagcagcgggggaagguguaccccuggaacuucgcugacaugguggaugucaaggcguccgcggaggccuucaucaccaaccugaccaacaagugcaccuaucugaucggcgaggacgugcucccaaagcggagucuccuguacagcgaguucaugcuacucaacgaacuuaacaugaucaaguacgacggccacgagcugccgguggccaucaagcagcucuacaucgagcaggucuucaagcaggaacacaagaaacagacgaaagggcgcgugcuggacuuccugaagcggaacggccucaucacagguagcgccaccgccgucaucaccggcauggacgacgcaauaaagggggaccuccagagcuaccgcgacaugguccggaucuucggcgccggcuuugaucacuccauggcagagcgcaucauccgcugggugacgcuguucggcgaggccaaggacauccuggagaacaagauccgugagguguacgggaacagcaucucagacagccagaugcgcgcuaucaagaagcugaaguacgcggacugggggcggcugucccaggccuucuuaauagccgucaaaggcugcgacaagucagggguggagcgcaacaucaucacgugccugcgcgccuccagccagaaccugauggagauccucagcgaucagggcaccuacaucaagcagaucaaggccuggaaccaccagcacaccacaaacaugauggacacccuggacuaccagcugguggaugaccucuaugucgcgcccuccgugaagagaucaaucuggcaaucccugugcaucguggaggagcuggucaagaucaugggccaggcccccaagaaaaucuucguggaggucacacggaccaagcaggccgaaaagacgaagaaagacagccgcaagaagcgguuagucgagcuguacaccgcgauagggaaggagggcgcagccuggaagaaggagaucgaggcccaccaggccggggacuuccgccguaagaagcuguaccucuacuacacccagaugggacggugcauguacuccaacgagcccauagccauggacgcucuguuuaccagugcuuacgacauagaccacaucuacccgcagagccuuacgaaggacggcagcugggauaaccuagugcuggugaaaucccagcugaacaaagaaaaguccgaccaguacccccuccggccggccauccgcgagaagaacaaggcccacuggcaguaccugugccgggccggguucaucagcgagaagaaguacgagcgccugaugagaaccacugaacucaccgcggaggagcugucuggcuucaucgcccgccaacuggucgagaccucccaggccacgaaggccgugaccgggcuccuggagcggaucuacaccaacaccgagaucugcuucgucaaagcugagacgguaagccaguuccgccaccagcacaacuuuaucaagauccgggagcugaauaacuaccaccacgcgaaggacgccuaccucaauauagugguggggaacguauaccacgagaaauucacgaaaaaccccugggaguucaucgccagauccaccgagagacggccguacaaucugaaccgcauguacgacuucgaccugcuaaagcaggggcgggugaucuggcaagugcccaagagucuggagaccgugcaggccaugaugaaguccaaugacgugcgcaucacgaagaagcugcucguccagaagggcgagcuguacgacgcgaccaucaccaaggcccacaaggcaaaggagggcaccuacuuuccccugaagggggccgacgcccgucuccgcgacguucaccgguacggcggguaugagaagaucaagaucgcuuacuacagcguguucagcugccgcgagaaggccuccaauacgauccacacccugaucauccccauccccguguauaaggcuggccugcuccagaccgaggccgaccuaaccgccuacgcguggcagacgaagcagaagaccaaacccaucaaggacaucuacagcgccaucacccccaucuacaagaagcugugcauaaauaccguggugaagauagacggguucaaguacuuccucggcggcaaaacgggggacuacauguggcuggaccccgccaucccgguaguccuggaugagcaggccgccgccuaccucaaggcaaucuccaaggugggccgggcggacgacguggagaacacggcccaggccaucgaccugaucaccgcggaagccaacgaggcuuucuacgacguccugcucaagaagauggaggccaagauauuugccaaggccuaccagaccaucguggagaaacuggccagcgagacggcccgcgagcgguuccgcgagcuguccaucggggcccagugcagcugccuccuggagaucuuaaaucuccuggcgaacaacaagaccaccuucaccuucuucaaggacaagaugggcgugaccaugucccggcgcaagcagcccauggaucugaccaaacuagaggagugcauagucuacgagaccagcaucaccgggcuguacgagaaggccgugucccugcucuga

SEQ ID NO: 7672 - RNA, 4059 nt, Artificial Sequence; identical to SEQ ID NO: 1872
  Cas9 variant

SEQ ID NO: 7673 - RNA, 4059 nt, Artificial Sequence; identical to SEQ ID NO: 1873
  Cas9 variant

SEQ ID NO: 7674 - RNA, 4059 nt, Artificial Sequence; identical to SEQ ID NO: 1874
  Cas9 variant

SEQ ID NO: 7675 - RNA, 4059 nt, Artificial Sequence
  Cas9 variant
augaagaagauccugggucuggaccuggggacaaccagcaucggcugggccuuuaucaaggagcccgagaaggacguggucggguccgagaucgucgacaugggcgugcgcaucgucccgcugagcuccgacgaggagaacgacuucgccaaggggaacacgaucagcaucaacgcggaccggacccucaagcgcggcgcccggcgcaaccugcagagauucaagcagcgccgaaacgcccugcucgagaucuucaaggagaagaagcugaucuccaccaacuucaaguacgccgaggacggccccagcuccaccuucagcacgcugaaccuccgcgccaaggcggccaaagagaagaucgagcugcaggaccuggugaagguguugcugcagaucaacaagaagcggggcuacaaguccucacgcaaggcgaaguccgaggaagacgacgguagcgcaaucgacuccauggggaucgcgaaggagcuguacgagaacgaccucacccccggccagugggucuacgaggcccugcagaaaggacggaagaacgugcccgacuucuaccgcagcgacuugcaggaggaauuuaaaaagaucgugaacuaccaguccgaguucuuuccagacaucuucaacgccagcuucgucgaagacuggaugggcaaggccuccacccccacaaagcaguauuucaacaagaaaggcgugcagcucgccgagaacaaggggaagcgggaggagcgccggcugcaagaguacaaguggcgcgccgaggccgugaacuucaagaucgaccuguccgagaucgcccucauccuaucccagaucaacagccagaucagcaacuccagcggauaccugggggccaucuccgaccggagcaaggagcucuacuucaagaaccugacggucggccaguaccuguaccaacagaucaagaaaaauccccacacacgccucaagggccagguuuucuaucggcaggacuaccuggacgaguuugagcgcaucugguccgugcagagcuccuucuacccccagcugaacgacgcccucaagcgggagguccgggacaucacuaucuucuuccagcgccggcucaagagccaaaagcaccugaucuccaacugcgaguucgaggaccaccacaagguugugcccaaaagccaccccguuuuccaggaguuucgcaucuggcagaaccugaacaaucugcugcuaaucaagaaggacaaccugaacgagaaguucgaccucgagcucgaguccaagaucgcgcucgccaacgagcuggcuuucaagcgggagcucaacgugaaggacgccuuaaagauccuggggcucaagcccaacgagugggaguucaacuucaccaagaucgaggggaaccgcacgaaccaggccuucuucgacgcguucgccaagaucaucgagcuggaggacggggagcccaucgaccugggcgaccucaaggccgacgauauccuggaccaguucagcgaggccuuccugcggaucgggauugacacagagcugcugcagguuaacuccgacaucgagggcgccgaguacgagaagcagagcuacauccaguuuuggcaucuccuguacuccagcgaggacgaccaaaaacugaaguuaaaccugauccgcaaguucggcuucaagccggagcacgcgaagauccucgccuccaucagccugcaggacgaccacgccagucucagcagccgggccaucaagaaaauccucccacaccuccaguccgggcugaucuacgauaaggcgugcaccuacgccggcuacaaccacagcuccucauucaccaaagacgagaacgagaagcgcgagcugcgggccgagcuggagcugcucaagaagaacucccugcgcaaccccgucguggagaagauccugaaccaaaugauuaacguugucaacgccauccucaaggaccccgagcugggucggccggacgagauccgcguggagauggcccgggagcugaaggcgaacgccgagcagcgcaagaacaugacgagcaacaucgccuccgccacccgggaccacgacaaguaccgcgagauccucaagagcgaguucggccuaaagcgggucaccaagaaugaccugcuccgcuacaagcuguggcuagagacugacgggaucucgcucuacacgggcaagcccauagaggccagcaagcuguucuccaaggaguacgacaucgagcacaucauccccaaggcgcgacuguucgacgauagcuucuccaacaagaccaucugcgagcgccagcucaacaucgacaaggccaacgugaccgccuuuagcuuccugcaaaacaagcuguccgccgacgaguucgagcaguaccagagccgcgugaaguccuuguacggcaaguugucgaaggccaagauccagaagcugcucauggcgaacgacaagauaccagaggacuucaucgcacggcagcugcaggagacccgcuacaucagcaagaaggccaaggaaaucuuauucgagauuucccggcgcgucagcgugacgaccgggacgaucaccgacaagcuccgggaggacuggggccugguggagaucaugaaggagcugaacugggagaaguaugacaagcucggacugaccuauaccaucgagggcaagcacggggagcgccugaacaagaucaaggacugguccaagcggaaugaccaccgccaccacgccauggacgcgcucaccgucgcccugaccaagccggccuacauccaguaccugaacaacuugaacgccaagggccugaacaauaagaagggcacggagguguucgccauagagcagaaguaccugaagcgggagaacgggaagcucugcuucaucccgcccaucgaaaacauccgcagcgaggcgaaaaagcaccugucccggauccuggugagcuacaaggccaagaacaaggucgugaccauaaacaagaacaagaccaaguccaaggccggccucaacgagcagaucgcccugacgcccagagggcagcugcacaaagagaccguguacggcaagagcuuccacuacuccaccaaguucgagaagaucggcgccagcuucaacguccagaagaucaauaccguggcgaaaaaggaggagcgggaggcucuccugaagcgccuagccgagaaugggaacgacccgaagaaggccuucaccggcaagaacacccuaaacaagaugcccaucuaccuggaccuggggaagaacauaaagcucuccgagaaggugaagacggucgugcuggagcagaacuacaccauccggaagaacaucgacccagaucugaagguggacaaggucauugacgugggcauaaagcgcauccucgagagcaggcuggaggaguucgggggcaacgccaaauuggcguucagcaaccucgaggagaacccaaucuggcugaauaaggagaagggcaucagcaucaagcgcgugaagaucuccggugucagcaacguggagucccuacaugugaagaaggaccacuucggcgagccgauccucgaccaggaggggaacgaaauccccguggacuucgugagcaccggcaacaaccaccacguggccauuuacgaggacgagaacgggaaccuucaggaggagguaguguccuucuucgaggccgugguccggcagaaccagggccugccaaucaucaagaagaaccacacccucggcuggaaguuccuguucacgcugaagcagaacgaguacuucguguucccguccgacgacuucgugcccgcugacgucgaccucauggacgagcagaacuaccaccugaucagccccaaccuguuccgcgugcagaagauugcgcggaagaacuacguguucaauaaccaccucgagacaaaggccgucgacaacgaccugcucaagagcaagaaggagcugagcaagaucaccuaccacuucuaccagacccccgagcaucuccgcgggaucaucaagauccgcaucaaccaccugggcaagaucauccagaucggggaguacuga

SEQ ID NO: 7676 - RNA, 4059 nt, Artificial Sequence
  Cas9 variant
augaauaagaaguacuaccuggggcuugacaucgggaccaacagcgugggcugggccgucacggacgagaacuacaaccuguacaaauacgccgggaagcgcauguggggcauccggcuuuucgaggcggccgacacggccgcggagcgccggaugaagcgcuccaaccggcgcagacucagccgcaagaaacagcggaucgaccuacugcaagaacuguucuccgaggagaucgugaaaaaggaccugaccuucuucauccgccugaacgagagccggcuccauuucgaagacaaguccaccggggagaaguacccccuguucguggacaaggaguacacggacaucgacuaucacaagcaguacccgacgauguaccaccuccgcaaggagcucaucgagaaccccgagccucacgacauccggcuggucuaccuggccugccaccacauccucaagaaccgcggccacuuccugaucaacggcagcaucuccgauguaaagaaccugagcuucgugugcggggagaugaucaaggaguucaacuccgucagcgaguacgaaaucucacucaccgacauccgggagcuggagcgcauccugagcgacaagaagaccgcuaaguccgugaaggcaaagcaggucgcccagcuguucgagugcacacccgccgaggacaaagagcagcagaaaugcgcgaaggccaucaucacgaaccucucgaagcucaucgugggccucaaggggaacaucuccaagauguuccaccagccccuggaggagaucagcaccaaguccuuuaaguucaccgaggccaaguaugaagacgagaucaugcccgccaucgaggagaacuauccggauuacgccagcgugauugaccguaucaaaggaguguacgacugguccguccugguggagaucuuagacggggaagacuaucugagcuucgcgaagguaaaggccuacgagaagcacggaaagaaucugcacauccucaagaacgucaugaagaaguacugcaaggacgagguguaccaggccuucuucaacggcaucaacgagaagaacggguacggcaacuacaucggggccauccgcaagaacggucacaccuacaagauggaccggugcaaaagcgaggaggacuucuacaagggccugcagaagaucuuguccacgaucgugcccgaucaggaggacgaggagcuccuggagaagcugaaagccgagguggagaaccagacccuccucccucuggcacgcucgaaggaaaacgggaccauacccaaccaggugcaccuccaggaacuuaugaagauccucgacaaugccaaggaguaccuggacuuccugaagaaggaggacgaguacggcaccauagcugagaaaaucaucuccaucgccaaguucagaauccccuauuacguagggccccugagucgccgccacaaggaggagggcuccaacaguuggaugauccggaaggaggaggggcgcaucuacccguggaacuucggcgacaaggucgauguggagcaguccaauaaggaguuuaucgagagaaugacgaacaaguguaccuaucucauuggcgaggacgugcugcccaagaacagccugcucuacuccaaguacaugguccugaacgagcugaacaaccucaagauccgcggcaacaagauaagcguggagcucaagcagcguaucuacaaggaccuguucugcaccauggccaaggucaccggcaagaggauccuggaguacuuaaagauggaggacccagagauaguacaggaggacaucuccggguucgacauagacuucaaaagcgcgcuggccuccuaccuggacuucaagaagcaggucgugggcaacgagaucgagaaggaccacuauaaggagaucauagaggagaucaucaaguggaaaacgaucuaugacgacgacagcaagaugaugcggcgcaugaucgagcgggaguauccggagguguucgacaaggagcagaucaagaagaucugccaacuuaaguauucaggguggggcaacuucagcgaccgcuuuuuaaacggcgugcguggcgccgacaaggagaccgaggaguccuacaccaucaucgaggcccuguggaagaccaacuacaaccucaugcaauugcugagcaagcaguucuccuucaaggaggagaucgaccagaucaacgccgagaaggccggcgauguggggaagaucaacuacgagaacacggugaaggaccucaucgugucuccgagcaacaagcgggccaucuggcagacgauacagaucgccgaggagaucaagaaggucaugaagugcgagcccgagcggaucuuuaucgagauggcccgcggcggggagaaagagaagaagcggaccgucucccgcaagacucgacugcaggagcuguacgcuggcugcaaggaugacacgcgcaacuggaugaaggagaucggggaccgggaagaacgcgaguucaacagccgcaagcucuaccuguacuacacccagauggggaagugcauguauacaggcgacgaaaucgacgucgacgcccugaugaagggaaacuccaauugggacaucgaccacaucuacccccagagccggaucaaggacgacucucuugacaacaugguccucguacguaaggaugugaacaacaagaagcggaauaagauccugagccccaaaauccgcgaggauaugaagggcuacuggacgaugcucugccagaagggccugaucuccaagcgaaaauacgaccgccugacgcggaccaccgauuucaccgacgaggaacucagcggguucaucgagcgacagcuggucgagacacgacaguccagcaaggccguggccgagcugcucaaucgccuguauaaagacuccgaagugguguacgugaaagccggccuggugagcgacuuucgccacgacaacgaccuccuaaagagccgccgggucaacgacuaccaccacgcgaaagacgccuuccugaacaucgugguggggaacguguaccacgugcgcuucaccagcaacccgcggaaguggaucaaggacaaccgcgacuccaacuacagcauccggcggguguucaacuacgacgucaagcagggcgacaagaucguguggcacggguccgagaacggcggccacagcaucgaccagauuaagaaaaucaugagccggaacgacauccucuauaccgaguacacauacugcgagaagggccagcuguucaacgaaacucuggccaagaagggcaacgagaaggccaucgcacucaagaagaaccuggaccccgugaaguacggcggcuauacgacccccaagaccucagcguucgcuuucgucgaguucgacgggaagaagaaggagcgcaagaaucacauaguggagauccccguguacgucgugaauaucgccaagcgggagccggacgccgugaagaaauaccuggaggagcgcaaaggcuauagcaacgucguaaucaagaaguaccccauaaagaaaaacucccucaucaaaauggacggcuaccuggcacgccuucgcggggcgaacgaaaaggacaucauccucaagaacgccgugcagcuaauccugaacaaggaccuguacgagaucguccggaagaucgagaaguaccuggaguauaaucugcaauaccaggccgaugccaaguucgagggauucaccaugaaggaccucaacaugaucuacgaggaacuguaccuaaagcucaaggaguccaucuuccagaagcggcccgcgcagcagaugaagacccuggagaaggggaaggaggccuucaucuccaucgagaaccugggcgagaaggccaaagugaucaacgaaaucaucgcaauguuccgcugcgacgcaaccaccguggcgaaccucaaggucaucaacgggagccaaaacgccggcuccaugaaggugaacaagaacacccugacguccaagucccugaaacucguacaucagagcaucaccggccuguucgagaccgaggaggagcuggucuga

SEQ ID NO: 7677 - RNA, 4062 nt, Artificial Sequence
  Cas9 variant
augaagaagaaguacuaccugggccucgacaucgguaccaacagcgugggcugggccgucaccgacgagaacuacaaccugugcaaguucaacgggaagaagaugugggggauccgccuguucgaggacgccaagacggcggccgagcggcgcaccaagcgguccaaccgccggcgcaucgcccggaccaagcagcgcaucgaccuccugcaggagcugugcgagaagaguaucuucgagaaggacccaaccuucuucauacggcucaacgagagcagccugcaccuggaggacaaguccacgggggagaaauacccgcuguucguggauaaggaguacaccgacaucgacuaucaucgcgaguaccccaccguguaccaccuccggaaggaacugaucgagaaccccgagccccacgacccgcgccucgucuaccuggccugcugccacaucaucaagagccggggccacuuccuggugaacggguccaucucugacgccaaggaccucuccuucaucugcgagaacaugaucaacagcuucaacgcggccuccgacuacaagaucaacauccaggacaugaccgcccuggagacgauccugacggaccgcaagauggccaagagcgugaaggcgaagcagaucguccagcuguucaagugcauccccugcgaggacaaggaacagcagaagugcugcaaggcuaucaucaccaaccuguccaagcugaucguggggcucaagggcgacaucagcaagaucuucaacgaguccuucgaggagaucaagagcuucaaguucgccgagaccaaguacgaggacgagauccugcccacgauggaggagaucuaccccgaccacgccgagaucaucgagaagaucaaguccaucuacgacuggagcauccuggacgagauccucgauggggaggaguaccuguccuucgccaaggugaaggcguacgagaagcacaagaagaaccugcacgaccucaagauccugaucaagaaguacugcgacgacgagaccuaccagagcuucuucaacggcaugaacgagaagaacaaguacuccaacuacaucggguccauccggaagaacggccacaccuauaaggucgagaaaugcaagucauccgaggacuucuacaaggagcugcucaagcugcugagcuccgugaacccgggccaggaggacgagucccuccuggagcagaucaaguucgagaccgagaaccagacgcugcucccccugcugcgcaccaaggagaacgggacaauccccaaccagguucacaugcaggagcucaucaaaauccuggacaacgccuccaaguaccuggacuuccucaacgagaaggacgaguacggcaccacggccgacaagaucaucagcaucgccaaguucaagauccccuacuacgucgggccgcuguccgaccggcacaaggagaacggcagcaacuccuggauggugcgcaaggagaacggccggaucuaccccuggaacuucgaugacaagguggacgccgagaaguccaacaaggaguucauccagcgcaugaccaacaagugcaccuaccugaucggggaggacguccuccccaagaacagccugcuguacagccgguacauggugcucaacgagcugaacaaccugaagauccgcggcaacaagaucuccguggagcugaagcagcagaucuacaacgaccucuucugcaccaaggcgcgcgucacggggaagaacauccuuaacuaccugaagaaggaggaccccgagcucgccgccgaggaccugagcggcuucgacguggacuucaaguccgcccugaccagcuaccucgacuucaagaagcaggucguagggaacgaaaucgagaaggacuacuacaaggagaucaucgaggagaucaucaaguggaaaaccaucuacaacgaggacucaaagaugaugaagcggaugaucggccgcgaguacccggagacccugaaccaggaccagaucaagaagaucugccaccugaaguacaacggcugggggaacuucagcgagacguuccucaacggcaucaaaggcgccaacaaggagaccggcgagugcuacaccaucaucgaggcgcuguggaagaccaacuacaaccugaugcagcuccugagcaagcaguucuccuucaaggaggagaucgaccagaucaacgccgagaaaacgggggccaucggcaagaucaccuacgagaaccugguuaaggaccucguggucagccccgccaacaagcgggccaucuggcagaccauccagaucaccgaggagaucaagaaggugaugaagugcgagcccgagcgaaucuucaucgagauggcgcggggcggggagaaggagaagaagcgcacggucucccggaagacucggcugcaggagcuguacaccggcugcaaggacgacacgcgcgacuggaugaaggagaucggggaccgcgaggagcgggaguucagcucccgcaagcucuaccuguacuacacccagaugggcaagugcauguacacuggggaggagauagacguggaccugcucaugaccgccaacagcaagugggacaucgaccacaucuacccccagucccggaucaaggacgacagcuucgacaauauggugcugguccgcaaggacaucaacaauaacgugaagggcaacaacaucgugccguccagcauccagaaggagaugaccuccuacuggaagauguuacuccaaaaggagcugaucagcaagaagaaguacgagcggcugacccgcuccacggacuucaccgacgaggagcucagcggcuucaucgagcgacagcuggucgagacccgucaguccagcaaggccguggccgcgcugcucaaccggcuguauaaaaacuccgagaucguguacgucaaggccgggcuggugagcgacuuccgccacgacaacaagcuccucaaaagccgccguauaaacgacuaccaccacgccaaggacgccuuccucaacauaguggucggcaacugcuaccgcaccaaguucacggccaauccccggcaguggaucaagaagaaccgcgacaccaacuacuccauccggcgcguguucgacuucgacaucaagcagggggacaagaucgugugguacggcaacaagaaugagaacggcaagcacaccauugaccagaucaagaaggcgaugagccggaacgacauccucuacaccgaguacacguacugcgagaaggggaagcuguucgacgagacccugaccaagaagggcaacaagaaggccaucccccucaagaagaaccuugacccccugaaguacgggggcuacaccuccgugaagacgucugccuucgccuucauagaguucgacgacaagaagaaagagcgcaagaaccacaucguggagaucccgaucuacguggccaacaucgcgaagcgggagcccgaggccgucaucaaguaccucgaggagcagaagggguacgugaacaucguggucaagaaguaccccaucaagaagaacucccugcugaagaucgacggcuaccucgcccgccugcggggcggggacagcuccauaaucacccugaagaacgccgugcagcuugugcuggacaagaaguccuacgaaaucauacgcaaggucgagaaguaccuggaccacaacagcaaguacgaggccaacagcaaacucgagaaguucaacgagaacgaccugaacaucaucuacaacgagcugugccucaagcugcggaacuccaucuaccagaagcgccccgugcaccagcuggagacccucgaacagggcaucgacaacuuccggagccuggagucccugaaggacaaggcuaagauaaucaacgagcuccuggccauguuccgcugcgacgccaagaccgggauggaccugcggcucaucggcggggccagcaacuccggccgcaugcggaucagcaagucccgccugacgagcaagucccugaagcucaucaaccagagcguuaccggccuauucgagaccgaggaggagcugguauga

SEQ ID NO: 7678 - RNA, 4062 nt, Artificial Sequence; identical to SEQ ID NO: 1878
  Cas9 variant

SEQ ID NO: 7679 - RNA, 4062 nt, Artificial Sequence
  Cas9 variant
auggccgccuucaaguacuaccugggccucgacauggggaccaacuccgugggcugggcggucaccgaccccaacuacaacuugcugaaggccaaggggaaggaccucuggggcauccgcgaguuuaacgaggcauccacggccgucgagcggcgcacccaccggaucagccgacggcgccggcaaagggagcagguacggaucgggcugcugaaggacuacuuccacgacgccaucggcgagguggacccagacuucuuccagcgccucgcgaacucuaaguaccaccuggaagacaaggacaccgaggugcgguacaagaacaacguguucaacgaugacgauuacacagacaaggacuacuucgaucaguaccccacgaucuaccaccuccgcaaggagcugaucgagagcaccgacaagcacgacguccggcugguguuccuggcccuccugaauauguucaagcaccgcggccacuuccugaacucggggcucggcgagaacagcggggaaaacaacaucaacaacgccuaccuagagcugaccaaccuccuaagugaguucacccaguacaaccugaacgaaacgaucgacggcaagaagaucgaggacauccucagccggcgugacaugucccgaacccgcaaggccgaggggcuggcggagauccugggcguggacuacaagaacaagcccuacaaggagcucauccggggccugugcgggcugaaguucaacgccugcgccaucuucccugagauccaaagcgacgaggucccaaagcucgacaucugccuguccgaggccagcuucgacgagaaauccgacgagaucgcaaacauccugggcgaggacuacuucgagaucaucauggcaaugaaggacaucuacgacaucgggagccucgcgggcaucaugaaaggccacaauuaccugucccaggcccgcgugaccagcuacgagaagcacaaggaggaccugcggcuccugaagaacgugauccgcaaguacugcuccaaagaagacuacgacaacuucuucaauagcgaggccgacggguccuaugccaguuacgucggcagcuacaacuccaagacaaagcagcgccggguagggaacaagcgcucguccgaggagcuguacaaggcgaucaagaagauccucaagaacgugcccgcggaggacgccgacguccagcggauccugaugagcaucgagaacgagaccuuccugcccaagcagcucacugccuccaacggcgugauccccaaccaggugcacgccaaagagaucaagaagauucugucaaacgcggagcgauaccugccguuccuccgggagaaggacgagaccgggcuguccgucagcgaaaagaucaugaagcuguucuccuuccagauccccuacuacgugggccccacgacggagaaguccagcaaggacggcggaaacggcugggugguccgcaaggaggagggccaggugcucccguggaacauugacgagaagaucgacaugaaggccaccagcgaggccuucaucuccaggauggugcgccggugcaccuacaucaguggggagccgguccugccgaaauccagccuggaguaccaguccuucugcgugcucaacgagaucaauaacaucaagaucgacggggagagaaucagcguggagcucaagcaggacaucuacaaggaggucuuccagaaaggcaagcggguuaccaagaagcagcuaugcaaguaccugcacacgcguggcaucaucgaggcagaggagcaggucaccggaaucgacguuacaaucaacaacgcccucaccacauacggcaaguucaaagcgauccugggggacgacaucuccaaggauagcgugcagaagauggucgagaacaucgucuuuuggugcaccguuuacggcgacagcaagaaguucuugaaggacaggaucgaggagaaguacggggagaagcucaccaaggagcagaucaagcgcaucgucggcuucaaguucaaagacuggggcaaucuguccaagaacuuccuggagcucagcggggccgacguguccacgggcgagagcguguccaucauccgggcccuguggaacaacaaccugaaccucauggagcugaucaacagccgccuguauaacuacaaggagcggcucgccgaauaucagaauacgaugaugaaaacccugucggacaucgaagcggaggaccuggaugaguacuacuucagugcccccgucaagcgcaugaucuggcagaccauccucaucaucaaggagcuggugaaggugcuggggugcgagcccgacaggaucuucguagagaugacccgccgcccggacgagaggaaaaugcgcacggagucccggcguaagaaguucgaggagcucuacaagaaggugaaggacgaggacguggacuggaugaaggucaucgcccacgccgacgagaccggcagcauccgguccaagaagauguaccuguacuuaacccagaagggccgcugcauguacaccgggaagcacaucgagcucagcgacuuauuuaacaacaaccuguacgacaucgaucacguuuacccccggcacuucgucaaggaugacaacaucgacaacaaccucguccuggucugcaaggagaagaacgcccacaaauccgacaucuacccccuggaggacgagauccucgcgagucagaagaacaugugguccgagcuccgccgguccggcuucauaacggaggagaaguacaaccgccugaucgggcggaacuccuucaccgacgagcagaaggcuggcuucauugcccgccaacucguggagaccagccaggggaccaagggagucgcuaacauccugcagcagcugcuccccgagagcaagaucguguacgccaaggcgucuaacgugagcgaguuccggaauacccgcgacaucccgaagucccggcugaucaacgaguuccaccacgcccacgacgcuuaccugaacaucgucgugggcaacguguacuacgucaaguucacgcagaacccccucaacuucauaaagaacgacuacgaccgcgacaagaccaagaacaacuacaaccugagcaagauguucgacugggacgucgagcggaacggggagguggccuggaucgcccagaagaaggacggcgaggcggggaccaucgcaaccgucaagaaggugcugggccgcaacacgccccucaugacccgauacaguuucgaggggaaggguggccugacuaacgagacccuguacagcgcgaagaaggccaaggaggagggcuacauucccuuuaaaaguagcgacgagaagaugaaggacgugacgaaauacggcggguucacauccgucaccggcgcguacuucuuccucguggaacacaccgagaaaaagaagcgcagccggaugaucgaguccgugccgcucuaccuugcgcagaagaucgaacagaacccccacgagcuggagaaguacugugagcagguccugggucuaaucgacuucgacauccgcgugcgcaaaaucaaaauaggcagccucaucaagcggaagggcuacuucuucuacaucacggggaagacaggccaccgccugauccugcggaacgccgugaacaugugccugaagaaggaaugggucaaguacauauccaagcuggagaaggccguggauaagaacaacguggaggggaucaucaccaaagagaagaacgagcugcucuacagcgagcugaucgagaaguuuaagaacuccaucuucagcaaccgccccaaccccgucggugacaaguuggacgaggccaaagagaaguucaucaaccucgacaucgagaagcaguguaucgugcugugccagauccugcagcucuccagcgugcugggguccgagugcgacaugacccugcucggcgagagcgcgcacuguggcaagauccugaucagcaagaagaucggggacgaggacaucuaccuuaucaaccaguccgucacgggccucuacgagaagaagaucaacuugcggaccguguga

SEQ ID NO: 7680 - RNA, 4065 nt, Artificial Sequence; identical to SEQ ID NO: 1880
  Cas9 variant

SEQ ID NO: 7681 - RNA, 4065 nt, Artificial Sequence
  Cas9 variant
augaagaagauccugggccucgaccuggggaccaacagcaucggcugggccuucaucaacgaagccgagaacgagaucgaggugucgagcauagugaacaccggggugaggaucgugccccuuacgaccgacgaggaguccgacuucaagaagggcaacaccaucagcaucaacgcggaccggacccucaagcgcggggcccgucggggccugcagcgauucaagcagcgccgggaggcccugcucgagacguucaaccgaaucaaguucaucgcgacggacuucgucuacgccgagaccggcgcggccaccacguucuccagcuaccagcugcgggcgaaguccgccguggaggcggugaccaaagaggaacuggucaaaguguugcugaugcugaacaaaaagcgcggguacaagagcucccggaaggccaagaccgccgaggagggcgacgccaucgacgggaugaagaucgccaaggagaucuucgagaacaaccuuaccccgggccaguggguguacaacagccuguccaagggcgggaaguucauccccgacuucuaccacucugaccugcagaaggagcucgagaagaucguccgcuuccagaaccaauuccacuccgagcagaucaacgacaaacugcuggcggacauccagggcaagagccggacgcagaccucccagcacuucagcaagacccucaacauccccuuagccgagaacaaggggacccgcgaggaaacuaagcugcagcacuaccaguggcggaacgaggcccucgccaacgagcuggacaugaagauccucgccuucaucaucaccgagaucaacaaccagaucaaccaguccagcggcuaccucggggcgaucuccgaccggagcaaggagcuguacuucaaccaggagaccguaggccaguaccaguacaagcagcugcaggagaacguacacgccaagcucaagaaccaagucuucuaccggcaggacuaccuggacgaguucgaaaagauaugggagacccaggccaaguuccacucggaacugaaugagaagcucaaggccgagaucagagacaucacgaucuucuaucagcguaagcugaagucccagaagcaccuggugucguucugcgaguucgagaagggccacaaggccauccccaaguccagcccucuguuccaggaguuccgcaucuggcagaaccugaacaacguggucgugaagaacgagaccaccaaggagguguucgagcuguccgaggagcucaagcagcugaucgcggaggaguuacaguucaaggagagcaugaccgauguccagaugcucacguucugcgagcugaagaaggggacccacacagugaacuucaagaagauagaaggcaaccgcaccaacacgugcaucuacaaggccuucgagaagauccuggagguggagggguacgagauggacuucuccaagaugaagccccucgagaucaaggagaccgucgcccccaucuucgagacccugaacauuaacaccgugauccuagacuucgaccccagcauccagggcaacgacuucgacaagcagccguacuaccagcucuggcaccuccuguacuccgcugaggacgacgacaaacucaaggaaacgcugaagaccaaguucggguuuaaggagaaccaccuccccuuccugcucaacaucaaccugcaggccgauuacggaagccuguccgcuaaagccaucaagaagaucuuaccccaccugauggacggccacaucuacgacaaggccugccugauggucgguuacaaccacagcuccagccucaccaccgcccagaacaacgaccgcguccuuaaggacacgcucgagcucuuaaagaagaacagccugcgcaaccccguugucgagaagauccucaaccagaugaucaacgugaucaacgcgaucaugaaagacccagccaugggcaagcccgacgaaauccggguggagcuggcccgcgagcugaaggccaacaacgagcagcggaaaaaggccaccagcgacauuaacaccgcgaccaccgagcacgagcgaauccggaagcuccuacacuccgaguucaacauuccacgcgucacgcggaacgacaucauccgcuacaagcuguggcucgagaccgggggcaucagccuguauaccgggaaccccaucaagggcuccgaccuguucagcaaagacuacgacaucgagcacaucauacccaagagccggcuguucgacgacuccuucagcaacaaaacgcugugcgagcgccagcugaacaucgacaaguccaacaagacggccuacagcuuccuccaggagaaguuguccgagaacgacuucgccgccuacgagaaccggguaaaggaccuguucaagaccggcaagauuaagagcuacaccaaguacaagaagcuccugauggccgacaacgagaucccggagggguucaucgaccgccagcugcgggagacccaguauaucgcgaagaaggcaaaggagauccuccuggaggugucccgcaacgucacagccaccaucggcucagugaccgauaagcugcgggaggacugggaguuaguggacgucaugaaggagcugaacugggagaaguacgacaagcuggggcucacccauaucgaagagggcaaaaacggggagcgccuguccaagaucaaggacuggacgaaacggaacgaccaccgccaccaugccauggacgccauuacagucgcguucaccaagcccgccuauauccaguaccucaacaaucucaacgccaagacccagggcgagaacaaggccaauucgaucaucggcaucgagaacaagcaccuguaccgggacaagaacaauaagcugcgcuucaucucccccaugaagaacuuucgcgaggaggcuaagaagcagcucgagagcauccugaucuccuacaaggccaaaaacaagguggucacgaagaacaagaauacuaccaagaaauccggagggaccaaucaaaagauccagcugacgccccggggacgccuccacaaggagaccguuuacggcaagcugcagcaguacgccaccaaggaggagaagguuaacgccagcuucacggaggauuacauccagaaggucgccaagaaggaguaccgggaggcgcugcucaagcgccuggaggaaaacgacaacgaccccaagaaggccuucacgggcaagaacgcccugaacaagacccccaucuacaucagccugaaggacaacaucaucgugccagagaaggugaagaccgucuggcuggagaccgacuacacgaucaggaaggauaucacaccggaccugaagaucgacaaggugaucgacguggguaucaagcgcauccuccagaaccggcugaacgaguucaacggcgaccccaagaaggccuucgucaaccugggggagucccccaucuggcucaacaaggagaagggcaucgccaucaagcgcgucaccaucagcggggugagcaacgcgcaggcccugcacaccaagaaggaccaccugggcaacgagauccucgacaagaauggcaaccccaucccggucgacuucaucuccacgggaaacaaccaccacguugcuaucuaccgggacgagaaggguaaccugcaggaggagguggucuccuucuacgacgccgugauccgccggaaccuggagcucuccgugaucaacaagaaccacgagaaggggugggaguuccuguucagcaugaagcagaacgaguucuucauuuuccccuccgacggcuucaacccccacgagaucgaccugcucaacccgaacaacuaccaucugaucagccccaacaucuuucgcgugcagaagaucuccaccaagaacuacauguucaaccaccaccuagaaaccaaggccguggacggggagaugcucaagaguaaaaaggagcuguccaagaccagcuaccacuucauccaaacgcccaccaaccugaauggcaucaucaaggugcgaaucaaccaccucggcaagaucguccaccugggggaguacuga

SEQ ID NO: 7682 - RNA, 4065 nt, Artificial Sequence
  Cas9 variant
auggccgacuucgccaaguaccagcccggcaugguggcggacgggcguaagaucccgcuggacuggacccucuacuaccuacggaaaaaggcccugacccaggccauccgcaaagaggagcucgccuggauccugcuaaauuucaaccagaagcggggcuacuaccagcuccgcggggaggaagaggaggagaacaguacgaagcacgaggaguacuaugagcugaagguaguguccguggaggccgccgaggagggcaagggagggaacacgugguacaacgucacacuggagaacggcuggaucuaccggcgccagagcaagaucgagcucaacgacuggguggggaaggugcggcccuucaucguaaccacggaguacgagaucgacggagugaccaucaagaaggacaaaaacggggaggugaagcgcuccuuccgggcccccagcgagaacgauuggggccugcgcaaaaagaggaccgagucccuguuggaggagagcgggaagacggucggcgccuucaucuacaaccacauccuguccgagcccgcagacaagauccgcggcaacuucauccggacgaucgagcgcaaguucuacaagaaggagcuggaagcgauccuccgagaacaaagcaagcaccagaaggagcucaaagacaucgacacccugaucgcgugcaucaaggagcucuacccgaacaacaagccccaccaggauagucugaucaagaaggacaugaccuaccugcucauaaccgaccugaucuuuuaccagcgcccccucaaaagcaagaagucccucaucgccgacugccccuacgaguauuaugaguacgugaucaaagagacgggggagaacaagcggcagagcaucaagugcauugccaaguccaacccguacuaccaggaguuucgccuauggcaguuuaucaucaaccugcggcuauucgaccgcaauaacgacaaagaggugacuagcgaguaccuguccagcauggaggacuacacccggcuguucaccuaccucaacgacaggaaggauaucaaccaggaaacgcugcugaaggacuucuuuaagcagaagaaggucaagcgaggcauggagaaggaguuccccauccgguggaacuacaucgaggacaaggagaagaaguaccccugcaacgagacgcgccaugagcuccugaccgcucuggggaaggugggcaucgaccacuccuggcucgacgacaaggagcuguucuaccggcuguggcaccuccuguacagcguggagucgaaggaggaggcggagggugcucugcgcaaauuagucgacaacgacgacuucgugaacgcuuucuugaagaucaagcccuucaagaaggaauacggggccuacagcgagaaggccauaaagaagcugcucgcggugaugcggaugggcaaccuguggaacgaggucgacaucugcgagcagacccgcgaccggauacagaauaucaucaagggggacaucgaugagaagaucaaggaccgcaugggcagaacguucucccagcugucagauuuccagggguuaccggaguggcuggccugcuacgugguauacggucagcacagcgaggccacagacauccagcgcuggaccaagcccgagaaccugauggccuauaucaacggcuucaaacaacacucccuucggaacccaauugucgagcagugcauccucgagacccugaggacgguccacgacauuuggaaagaggccgggcacaucgacgagauccacaucgaacugggccgggggaugaaguccaccgcggaccagcgcgcccggaugagcaaaaguaucaugcagaacgagaacaccaauuuacgcaucaagagccugcuaauggaauuaaagaacgccaaggaauuugagaacgugcggcccuacagcccgaugcagcaggaaauccugcggaucuacgaggagggcgcccugcaggagcucaccaaggaggacgcacaguacaacgagaucuccaagaucagccagauggcacagccguccgccaacgagcugcuuaaguaccggcucuggcuggagcagaaguacugcagccccuacacgggaaagcccaucucccugucgaagcuguucaccuccgccuaccagaucgagcacaucaucccucagagccgcuacuucgaugacaguuucaccaacaaggucaucugcgaggccgaggugaaccagcucaagagcaauaugcugggcuaugaauuuaucaagaagcacggcggggagaucgucaggugcaccaugaucggggacgugaagcuccuggacgcgaaggaguacuacaauuuugugacggagcacuacaccaacaaccgucgcaagaaggagaaacuguugauggaggacaucccccaggaguuucugaaucggcagaugaacgacucccgcuacauaagcaagaagguuauggccauccugucaaacauugugcgggaagaggacgagcaggaggccaaguccaaguucgugaucgcaugcucagggggcaucaccgaccgccuuaaacaggacuggggacugaacgacgucuggaacuccaucguguacccccgguucgaacgcuuaaacaagcucaccaauacagagaacuucgggcggugggaaaacaagaagggcaagcaggucuuccagacgagcgugccccuggaacugcagaaggacuucuccaagaagcgcauagaccaccggcaccacgccauggacgcgcucgugaucgccugcgccagcaacaacaucaucaacuaccugaacaacgaguccgccaagagccaggagaagcgcgaggaccugcggaagaagcucugcgacaagaaccgaaucauccgaaagccgugggaaaccuuuacccaggacgcucacaccgcgcuggagaacguggucguauccuucaagaacuacauccgcgugaucaacaaggcgacgaacuauuacgagaaguaugacaagaacgggaagaaagagaucgccgagcagaagggccaagacaugugggccauccggaagcccaugcacaaggagacagucuucggucaggugaaccugcgccggaagaucaccauaaagcucaaggacgcacuggagaagauccccgcgaucugcgacaaggagcugcgcgacuacaucaacauccucguggccaagcaguucaacaagaaacagauccuugcccacuucaaaagcauaaauuaccggcugaauaugaaaagcgucgacaaaguggacgucuggcaguucagcaacgagaaggaacccauggucgccacccgcaaguccguggacacgaguuucgauacaaagcgcaucgcgaccaucaccgacacggggauccagaaaauccucuugaacuaccugaaagcgaaaaacaacgacccgaacaucgcauucacccccgaaggcaucgcggagaugaauaagcacaucaccgaguacaacaacgggaagcagcaccagcccauccucaaaguucgggucuccgaaccgaaaggcgccaaguaccaggucggcgagaccggcaacaagcgaagcaaguucguagaggcgcagaaggggacgaaccuguauuucgcuaucuacgaggacaaggagggcaacagguccuacaacaccaucccccugaacgaggucaucgagcgcuugaagcagggcuuaagcccagugcccgacgccaacgagaaguccaucccucugaaguuccaccucagccccaacgaucugguguacgucccuaagacggacgaggagaacgagauuaaaauggggcagaucuacaaguucguggacagcuccggcaccaccgccaacuucguaccccaccgugugagcaaccugauauacaacguggacaagaagaucgccgagaauuucugcaaccacgaaauaauacagaacgaauacgggaucggcuccccacagaguaagaaccagaaguccaucaccggcgagaugaucaaagcggugugcuggaagcucgaggucgaccgccugggcaacauccacaagaucaucaaauga

SEQ ID NO: 7683 - RNA, 4065 nt, Artificial Sequence
  Cas9 variant
augaagaagauccugggccucgaccuggggaccaccagcaucggcugggccuucaucaaggagcccgagaaggacguggucggguccgaaaucguggacaugggcgugcgcaucgucccccugagcuccgacgaggagaacgacuucgccaaggggaacacgauuagcaucaacgcggaccggacccucaagcgcggcgcccggcgcaaccugcagcgguuuaagcagcgccggaacgccuugcucgagacuuucaaggagaagaaccugauccccagcaacuuccaguacgccgaggacggccccagcuccaccuucagcacgcugaagcuccgcgacaaggccgcgaaggagaagaucgagcuggacgacuucgugaaagugcugcuccagaucaacaagaagcggggguacaaguccagccgcaaggccauguccgaggaggacgagggcaccgccaucgacagcauggggaucgccaaggagcuguacgagaacgaccugacccccggucagugggucuacgaggcgcucaagaacgggcggaagaacgugccggacuucuaccgcuccgaccugcaggaggaguucaagaagaucgugaacuaccagagcgaguucuaccccgacauccugaacaccuccuucgucgaggacuggaugggcaaggccagcacgcccacgaagcaguacuucaacaagcggggcgugcagcucgccgagaacaaggggaagcgcgaagaacggcgccugcaggaguacaaguggcgggccgaggccgugaacuucaagaucgaccuguccgagaucgcgcucauccugagccagaucaacucucagaucagcaacagcuccggcuaucugggggccaucagcgaccgcuccaaggagcucuacuucaagaacuuaaccgucggccaguaccuguaccagcaggucaagaagaacccccacacccggcucaagggccagguguucuaccgccaggacuaccuggacgaguucgagaagauuuggagcgugcaguccagcuucuacccgcagcugaacgacgagcucaagcaggaggugcgggaugugacgaucuucuuccaacgcagacugaagucccaaaagcaccugaucagcaacugcgaguucgaggagcaccacaaggucgugcccaagucccaccccaucuuccaggaguuccggaucuggcagaaccucaacaaccugacccuaaucaagaaggacaaccucaacgagaagugcgagcuggcccuggaggacaagaccgcccucgccaacgaguuggcguucaagaaggagcugagcgugaaggacgcccucaagguccuaggucugaagccauccgauugggaguucaacuucacaaagaucgagggaaaccgcacgaaccacgccuucuucgaagccuucgccaagaucaucgagcucgaggacggggagccgaucgaccugggcaaccugaaggcggacgacauccucgaccaguucagcgaggccuuccugcggaucgggauugacaccgagcugcuccaggugaacuccgacaucgagggcgccgaguacgagaagcagagcuacauccaguucuggcaccuccuguacuccagcgaggacgaccagaagcugaagcagaaucucauccgcaaguucggcuucaagcccgaacacgccaagauccuggccuccaucagccugcaggacgaccacgcgucccucagcagccgggcaaucaagaagauccugccccaccuccaguccgggcugaucuacgacaaggccugcaccuacgccggauacaaccacucuucgagcuucaccaaggacgagaacgagaagcgcgagcugcgggcggagcuggagcuccugaagaagaacucccuucgcaaccccguggucgagaagauccucaaccagaugaucaacguggucaacgccauccugaaggacccgaaccuggggcggcccgacgagauccgcguggagauggcccgggagcucaaggccaacgccgagcagcgcaagaacaugacgagcaacaucgcgucugccacccgggaccacgagaaguaccgcgagauucugaagaaagaguucggacugaagcgggugaccaagaacgaucuccugcgcuacaagcuguggcucgagaccgacgggaucagccuguauacgggaaagcccaucgaggccuccaagcuguucagcaaggaguacgacaucgagcacaucauccccaaggcccggcuuuucgacgacuccuucagcaacaagaccaucugcgagcgccagcugaacaucgacaaggccaacgucaccgcguucuccuuccugcagaacaagcucagcgccgacgaguucgagcaguaucagucccgcguuaagagccuguacggcaagcuguccaaggccaagauccagaagcugcugauggccaacgacaagaucccggaggacuucaucgcccgccaacugcaggagacccgcuacaucagcaagaaggcgaaggagauccucuucgagaucacgaugcggguuagcgugacuaccgggaccauuacggacaagcugcgcgaggacuggggccugguggagaucaugaaggagcucaacugggagaaguacgacaagcugggccugaccuacaccaucgagggcaagcacggggagcggcucaacaagaucaaagacuggaacaagcgcaacgaccaccggcaccacgccauggaugcccuuaccguggcccugacgaagcccgcguacauccaguaccucaacaaccugaacgccaaggccaucggcaacaagaagggcaccgagaucuucgccaucgagcagaaguaccugaagcgcgagaacgggaagcucugcuucaucccgcccaucgagaacauccgggccgaggcgaagaagcaccuguccaagauccuggucagcuacaaggccaagaacaaggugguuacgaucaacaagaacaagaccaagaagaaggccggcuucaacgagcagaccgcccugacgcccagagggcagcugcacaaggaaaccguguacggaaaguccuuccacuacagcaccaaguucgaaaagaucggugccuccuucgaugcgcagaagaucaacacgguggccaagaaggaggagcgggaggcccugcucaagcgccuugccgagaacgggaacgaccccaagaaggccuucacgggcaagaacucacugaacaagaugcccaucuaccucgaccuggggaagaacaucaagcuguccgagaaggugaagaccgucgugcucgagcagaacuacaccauccggaagaacaucgaccccgaccugaaaguggacaaggucaucgacgugggcaucaagcgcauccuggagagccggcucgaggaguucgggggcaacgcgaagcuggccuucuccaaccuggaggagaacccgaucuggcucaacaaggagaagggcauccccaucaagcgcgugaagaucuccggggucuccaacguggagagccugcacgugaagaaggaccacuucggcgagaaaauccuggacgaggaggggaacgagaucccugucgacuucguauccaccggcaacaaccaccacguggccaucuacgaagacgaggacgggaaccuccaagacgaggucgugaacuucuacgaggcggugauccggcgcaaccagggcgagagcaucaucaaguaccggcacgaggagggcuggaacuuccuguacuccaucaagcagaacgaguucuucgucuucccgucacaggacuucaaccccaacgacuucgaccugcucgaccccaagaacuacgaccugaucucccccaaccuguaccgcgcgcagaaguucagcaaggugauguacgggaacuccgccgugcgggacuacgucuuccgccaccaccucgaaacggugcugaacgacgugaaggagcugaaggacgucgccuacaagcagcucaagucucugcaguaccugaauggcaucaagaaggugcggcucaaccaccuggggcagaucauccagguuggcgaguacuga

SEQ ID NO: 7684 - RNA, 4065 nt, Artificial Sequence
  Cas9 variant
augacgcugcauuacaacgugggccucgacaucgggaccaacagcgucggcuacacgaucguggacgacaaugggaagauccuccaggugaagggcaagaacggguacggcguccgcguguucaaggagggcgccaccgccgcggagcggcgcaucuuccguaccacucaccgccggcugaagcgccggaaguggcgccuccgccugcugcaggacuucuucgagcccuacauccucccgcaggacgacggguuuuucauccgccggaaggaguccaaccuggugcugaacgaccgcgacgaggacacggccagccucuucaacgaccgguccgaccgcgacuucuaccaggccuaccccaccaucuaucaccuccggcaggcccugaugacggagaagcgccaauucgauguccgugagaucuaccuugccaugcaccacaucaucaaguaccgcggccacuuccuacugaacggaaccguaaacaacuucacgaacaacaagaucgaccuccacagcgacuucgaggagcugaacgcacugcucuugaacgugauccccgaguuaaaguuccaaaucgaccucgaccacuccaccauguuucagaccacccuguugaacacgaccaucagccggucgggccgccagcgggaccucguaaagucuuucuacaacggguccgacgauaaacagcuggccaagcagcagaagucgguggccaccgagcuucucaaggccauccugggccugaaggcgaaguuccacaaguuauucaaccuggaccugcucgagaccacggaaugggaguucagcuucgacgccgaggacaucgacgacaagcuggccaagcuggagccccuuaugacugagaaccagcagcaggucauggauauccugcagcgcaucuucgccgccauuacccugaacggcaucgugccggaggggaagacccucagugcuuccaagguggacagcuaccagaagcacaagcaggaccugaagcugcucaaggccaucgcccagcacucggauaagaagacggccaccgugcugcagaccgccuacaacgaguacaucaacggcaucgcgagcaaaccucugaagcaggaagauuucuacaagcgccucacaaacgccguuaagaaguccagcgacccccagguggccgacaugcuggcccugaucgaccaggagaaguuccuccccaagcagcggacgaaggagaacggugccaucccgcaccagcugcaccagcuggagcuggagcgcaucaucgacaaccagaaggacuacuaccccuggcucgccgagcugaaccccaaccaggcccggcagaagguggccaaauacaagcuguccgagcucgucgcguuccgcgugcccuacuacgugggcccgcugaucgagcccgagguccagcaggccaccagcaaugcgcacuucgccuggauggcccggaaggaggcgggccccaucacccccuggaauuucgaccagaagguugaccgcaacgugagcgcugagcgguucauaaagagaaugaccacgaaggacaccuaccugcucgcugaggacgugcugccgcugcacucccucuuguaccagcgguucaucgugcugaacgagcucaacaacguccgcgugaacggccagaagcugaccaagaagcagaagcaggccguguaucaggaccuguucaaacggcagccccacguaaccaagaagcaguucaagagcuaucucgugcagacgggagaguucgccgaguccagcaagaucgaggggcuggccaacgagaccuccuucaacucuggccugaccaccgaaaacgaguugcgcaaaaucuucggggcgcagcuugacgaggcccgguaccagguggauuucgagcaaaucauugagugggccacgcuguucgaggacgcaaagauacuccggaccaagcuggccgagaucaccuggcugaccaccgagcagaucgagaagcucgcgggcauccgguaccgcggcuggggacgguucucccgcaagcugcuggccgggcuccgggaccagaacgggcagcagaucaucgaccugcugugggauacgccgaacaacuucauggucaucgugagccaggccgccuucuccgaggccauaaccaaggagaacgagaagcucaucgaccgccgcggugcgcaagacgucaucaccgaccuguacaccucaccccagaacaagaaggcccugcggcagguccucgccaucguggccgacgugcaaaaggcgaugggcggggucccgccccagcgcaucuucaucgaguucgcccgggaggacgagaagaacccccgcagaaguguggagcgcagccggcagcuggagaagcuguaccagacgaucuccaacgaguuccucaucaacagcgaagugcgccaggaacugaaggaagccgucgaccagaaggugaauuucaaggaccgucuauuccucuacuuccugcagggcgggguggaccuguacuccggcaagcggaucaauaucgaccagcucucccauuacgacaucgaccacauccugccccaguccuucaucaaagacgacagccuggacaaccguguccucgugucccaaaaacugaaccgaagcaagagcgacuccgugccccugagcgaguuugccaacuacaaguucgggcccgccaugcaggcgaaguggcuccagcugaaggaggcuggucuacucuccaagcggaaguaugacaaccugacccuggacccaaccaagcucagcaaauucgcgccgcugggguucgucaaccgccagcugguggagacccgccaggugaucaagcucgccgccaaccugcuggccuccgaggagacaaagguggugaccaucaaggccaacaugacccaccaggugcggaaggagcucgacuucccgaagaacagaaacgucaacaacuaccaccacgcuuucgacgccuaccucaccgccuuugugggcauuuuccugagcaagcgcuaccccaagcucaagcccuacuucacguacggugacuuccagaaggggaacaaacuuccggaccugaagaauuucaacuuccucuacgaguuaaagaacaaggaccgguccaucgacucaaacaccggugagaucaucugggauaagcagcgcgaccuggcguacaugaacaagaucuacaacuucaagaaggugaccgucgugcacgaggugcucaccaagucgggugcccuguacaaccagacgcuguacaaggccagcgaggacaaggccuccggccggggcaccaagcagcucaucagaaagaaggacaauaugcccaccgagcuguacgguggcuacaccgggagcacguccgccuucaugagcaucguccgccuguggaagaaggacaagcccuacuacaagguggugggcauccccacccggauggcugccaagcucgccaaccaggcccagcugcuggacuaccucaccaagaaguucaccacgcgcaagcuggucaagaagacaggggacuacaagaccacgguggagcgguucgagcugguggugcccaaagugggcuucaaccagcucgugaucgacggcgggcagcccuucaugcugggcuccgcaacguaccaguacaacgcucgcgagcuguucauuagcaaggaggccgucaaggcucucaacaagcagcugucuacccacguggacuuggugcaagucuucgaugagauccucguccaggugaacaggugguucccccuguacgacaccaacggguuccgcgagaagcugucgcacggccgggauagguucaugaagcucaacgacagcuucgaggagaaguccgacacccagaucgacguguuaaaccgcauccugaucggguuccacgcaaacgcggcccgcacgaaccucaagauccugggacuuggaaccgaccugggguucaugacacagcaggccggcauccggcucaccgagaaggccauccuggugcaccagagccccuccgggcuguucgagcgcaagguggcccuccgagaccugaaggggcugcgcuga

SEQ ID NO: 7685 - RNA, 4068 nt, Artificial Sequence; identical to SEQ ID NO: 1885
  Cas9 variant

SEQ ID NO: 7686 - RNA, 4071 nt, Artificial Sequence
  Cas9 variant
augaagaaguucgaggaguacuacaucggccuggacauggggaccggcagcguggggugggcagugaccgauuccgccuacaauaucaucaagcgccacgggaaggcgcucugggggauccggcuguucgagagcgccaagacggccgaggagcggcggaucuuccgcacuucccgcagacggaccgagcgccggaagaaccgccugcaccuccugcaggagaucuucgccgaggagaucagcaagaaggacaugggcuucuaccagcggaugaaggaguccaaguauuggcacgaggacaagaaggacaucaacggcaacaugcccgagcugccuuacgcccucuucgcggacgacggguucaccgacaaggacuacuauaagaaguaucccacgaucuuccaccuccgcuacgcccucgccaccaacaccaccgacaagcccgacauucggcugcuauaccuggccuugcaccacaucaucaagcaccgcggccacuuccuguucgaggggaagaagcugagcgaggugaaggaguucuccacggcgauagaggcccucgugcagcaggcggaggagcaggagaucgaccucaagagccugacccaggaggagguccugacccagcuggagcacaucauguccgacgcacagugcaccaagagcgacaagaagacccaggugucgaaacugaucgugggcacggacaagcagaaacagaagcaggagaaggccaucgcggcccucaucaccgggugcaccgucaaguugagcgacaucuucgcugaccccgaacuggacaaggaggagaucuccaagaucugcuucagcgacaacggcuacgaggagaaggagguggaaaucgaguccgugcuggccgaccgguuccugcugaucgccgcggcgaagggcgucuacgacuggacggugcuccacgacauccugggggacgcccgcuuccugagcgaggccaaggugaagaccuacgagaagcaucgggacgaccuccgcaaggucaagcagcuguugcggauggacaaggagguguacgaggccguguucggcgucuccgagaagaacgaagcgaacuacucagccuacaucgggauggccaagaagaacggaaagaagcagccaaucgagaagaagugcucccaggaggacuucuacaaguuccucaagaagcagcuggaccgccugagcguggacgagaugggccaggagaucauagacgagcucaaggccgagauggaucuggggacccuguuccccaagcagaugauccgggacaacggcgugauccccuaccagcuccacgagaacgagcugaacgccauccuggacaacgcgcagaaguucuaccccuuccuccuggagaaggaccaggacggguacaccccggucgagaagauccagaagauauuccgcuuccguauccccuacuacguaggcccccugaacacggcccaccaggacaagggcggacacuccugguccgugcggaagaaggagggcaagaucuaccccuggaacuucagugagaugaucgacgaggaggaguccgcuacgaaguucaucgagcgcaugaccaacaagugcaccuaccuuaucggggaggacguccugccgaaggagagccugcucuacgccaaguucaacgugcugaacgaguugaacaauuuacggaucgacggcgagcucaucgcgcccgagcugaaacaggacaucuacaacaacguguucaagaaguaccagcgcguaacggggaagaaggugaaggacuaccugcggaucaacggcgucaucuccaaggagcaggagcucagcggguucgaccagaacuucaagagcagccugaaggccuaccacgacuucaagcagaucguggguacaggcgugcugagugaguccgagcaagaggacaucguccgcgacaucaccuuauucgccgacucccagaagaugcugaagcagcggauccaccgcaaguaccccaugcucucggacaagcagaucgcccagcucgccaacaagaaguacgcgggguggggacggcugucccgcaccuuccuggagaacaucgagucggugaacaaggagacgggggaggugaugaacaucaucaccgcccucugggagaccaacgagaaccugaugaagcugcucuccggcaaguacgacuacaccaagcagaucgagcaguggaacgcgcggcagaugaagaaaggggagaucgaguaccaggacaucgaggagcuguacgucagccccgccgugaagcgcccgaucuggcagacgaucaagaucgugcgggagaucaccaacaucaugggcggcgcucccaagcgcaucuucgucgagguggcgcgggagcccggggagaagggcgugcgcaaggucucccggcgcaaccaacugcucgaccuguacaaggccugcaagaaggaggcacccgagcuguacgaccggcucgccaacaaggagagcgacaacgcccugcgcuccgacaagcuguuccucuacuauagccagauggggcgcugcauguacagcggugacgcgauugaccuggacgagcuguucaccaaccgguacgacaucgaccacaucuacccgcaguccaaggugauggacgacagcaucgacaaccgcgugcucgucaagcgggaccugaacuccaagaagaccgacacguuccccgugagcgaggaguaccgcaaggccggcaaggcacugugguccacccuccugaagaaggggcugaucagcaaggagaaguacaagcggcucacccgcaccgagcccuucggcgaggacgagcuggccggguucaucgcgcggcaacugguggagacccgccaguccacgaaggccguagcccaccuccuggaggaggccuaucccgacgccgagaucguguacgcgaaggcgcgggccgugagcgaguuccgccacaaguucgacaugaucaagguccgggaagugaacgacuuccaccacgcaaaggacgccuaccugaacaucguggucggcaacaccuacuacgugaaguucaccaaggacgcggccugguucgugcgcaacaacccggggcggaccuacaaccucaagaagauguucgagaacgagacggucaagcgcggcaacgagaccgccuggauccccggcgacaacgggaccaucugcaccgugaagaaguggaugcggaagaacaacgugcuguucacgcgccgugccuacgaggucaagggcggacuguucgaccaaaacauccucaagaagggcaaggggcagauccccaucaagggcggcgccgacgagcgccugcggucccgcgacaaguacggggcguacaacaaggccagcggcgccuacuucaugcugguggaguccgacgggaagaagggcgagcggaagcgcaccaucgaguucgugcccgucuaccucgccaagagccuggaggaguccguggagcugcgccggcgcuacugcgaggaggagcucgggcuggugaacccggacguccggcugagcaagauccgcaagaacgcgcucaucgacguggacggguucaagaugcaccuggugggccggaccgagaaccgccugcuccugaucggggccacccagcuggucuuguccgaggacgaccagcagcugaucaagaagaucggcaaauacugccuggaccaccgggagaacaaggacgccgugcucagcgaaaaguacgagcugacgauggaccuguucgagaagcucuacgacaucuucguguucaagcuggagcagaccgucuacgccgugaagcuguccaagcaggccaaggaccucaaggaggugaaggaggaguuccuggcgcuggacgacgaacagaagugccuccugcugauggagauccuccaccuguuccaguguagcccccagcuggccaaccucaccaacaucgggggcggcaagagcgccgggucccugaagauccugagcgacaucaccaagcaacaguccguccuccugaucaaccagagcaucacgggcuuuuacgagcaggucaucgaccugaagaccaucuga

SEQ ID NO: 7687 - RNA, 4071 nt, Artificial Sequence; identical to SEQ ID NO: 1887
  Cas9 variant

SEQ ID NO: 7688 - RNA, 4071 nt, Artificial Sequence; identical to SEQ ID NO: 1888
  Cas9 variant

SEQ ID NO: 7689 - RNA, 4071 nt, Artificial Sequence; identical to SEQ ID NO: 1889
  Cas9 variant

SEQ ID NO: 7690 - RNA, 4071 nt, Artificial Sequence; identical to SEQ ID NO: 1890
  Cas9 variant

SEQ ID NO: 7691 - RNA, 4074 nt, Artificial Sequence; identical to SEQ ID NO: 1891
  Cas9 variant

SEQ ID NO: 7692 - RNA, 4074 nt, Artificial Sequence
  Cas9 variant
auggccgccaagaacuacaacaucgggcuggacauugguaccaguagcaucggcugggcgaucguggacgacaacuaccagcucaugcacgccaaggggaaguacggcuacggcacccgcaucuacagcgagggccagaccgccgccgacagacgaggcuuccggaccacccgccggcgacugaaccggcgcaaguggcggcugcgccuccugcaggacuucuuugaaccguauauccucccgcaggacgaggcguucuucauucggcagaagcaauccaacuuggucccccaggacaccaagaagcaguaccccgagagcgugcuguucgacgacacgucggacaaggacuucuacacggaguaccccaccaucuaccaccucaggcaggcguugaugaccgagaaccggcaguucgacauacgcgaaguguaccuggccauccaccacaucgucaaguaccgggggcacuuucugaauaacgccccuguuaagacguucaagagcggcaaccucgaccuggccaucaaguucaacgaacugaacgaggaguucaagaguguguaccccgaccucgagcugcaauucaacuuagaccagaucgacgaaaucaagaagauccuccuggacagcaccaaaucccgcuucgaccggcaaggggaggcggucaagcugaucuauacagugagcgaggugaagaccaucgagaaacuccagaacaagaucgucaagcaauuccuguccggaauccuggggcucaauacgcgauucgacgugcucaccaauaccgagagugaugacuccauguggaaguucagccuggacuccgagagcuccgacgacgcccucgacgagaucaucgcccagcuggacgacccugccauccacguggucgagcuggucaacgagauccacagcuccaucacccuagccggcaucgugcccgagggccaggggcugagcgagagcauggucgagaaguacgaggcgcacaaagcgcaccuccagcuccugaaagccguggagaaacuuguggacaagaaggccgccgacaagcucgaagucgcguacgaccaguacaucaacggcaaagacuccaagcaguucaucaaggaggacuucuacaaggccgugcagucggagaucaagggcguugccggcgacgaggucgccgagaucaaccaguuaauagaguuagaccaguucaugccgaagcaacggacgaaggaaaacggcgccaucccccaccagcuccaccagcacgaacuggacgugaucauugagaaccaguccaaguacuacgacuggcugggggagaaagugggcaacgaguacaaacucgacaagcuggucagcuuccgcgugcccuacuacgucgggccccugguggacaccgcgucuaaggagaagaaggacgagacucgguucgcuuggauggugcgcaagaacccggagucuaccgaggccaucacgccauggaacuuugaggacauagucgauaaaaaugccuccgccgagaacuucaucaagcgcaugaccaccaaggacaaguaccuccugaacgaggacguguuacccaagugcagcuugcugacgcaggacuucgagguuuacaacgagcugaacaacauccgggucaacggcgagaaguucacggcggagcagaagcaacugauacacgacgagcuguucacuaagcacgccuccgugucaauaaagcagcugaaggacuuccugguguccgagcuuauguacguccgcgauaaccugaagguggagggcuuggccgacgaaaagaagcucaugagcucgcugagcacccaguucgacuaccagaagaucaucccagaccagaucaacgauguaaaguaccgggaggauaucgagcagaucaucgagugguccaccaucuucgaggacgccgcgaucuucaagacgaaguugaaagagaucgacuggcucaccgacgagcagcgcaacaaacuggccaacaagcgguaccgcggcuggggcagccucucaaagcggcuccuggccugccuggucgacgagaacgggcagcgcaucaucgacaucuugcgggacagcuccgacaacuucaugaugaucgugaaccgaccggaguucaaacaggccaucuucgacgagaacgccaaccugacagagacuaacagcaaaaaggacauguucgagaugaucgacaacuucuacacgagcccccagaacaagaaggccauucgccaggugcugcucgucgugcaggacauccagaacgcuaugggcgggguggcgccccagaagauuuucaucgaguucgcccgggaagacgaagucaacggccggcgcaccaacucccgguacagccaaauccgcgagauguauuccaaggugacggacgacgugaucaacaagaccgugcgcggugagcuggaagccaacaagggcagccugaacaaggagaagcuguuucuguacuuccugcagggcgggaucgaccucuacuccggcaagacgaucaacaucgacaacaucagcuccuacgacguggaucacgugcugccccagagcuucaucaaggacgacuccaucaacaacaagguccugguuaacgccaaagggaaccgggugaagaacgacaacgucccgauggagcuguucggcgccaagauguaccccacguggaaacggaugguggacaccgggaucauguccaaggccaaguucaagaaccugacccugaaccccgacaacguggacaaguucaaagccgaaggcuucaucaaccgccagcuagucgagacccgccagaucauaaagcugguggcccagauccugaacgacaagcucggggaugauacgaagaucgugucuguaaaggcgaaccucacccacgacaugcggguguucuucgacuuccccaagaacaggaacgugaacaacuaucaccacgccuucgacgcguaccugagcgcuuucgucgggaccuaccucuacaagcgcuacccuaaacuucaacccuacuucguauacggcgaguuuaagaagauggacaagcugaagaacaugaccuccuucgacuuccuccgcgaccugaagcacacggacaagguggucgacaaggacaccggggagaucaucgcggacaagcuggccgugaucaccaacaugaacaagaucuacgacuucaagaagguucucgucacccacgaggugcacgagaacagcggcgccauguacgaccagacgcuguacccugccaagcuggacaagucccucggccgcaagggggcgaagcagcugauucccaagaaggaugacaugccgaccgcgcuguacggcggauauacgggcucaaaggaugcauucauguccaucgugcgccuuaagaaaaaggacgaggucuacuacaaggugaucgggauccccgugcggaucgccgacagcguccaacacggcaaggagguggacguugaggcccugacccaguuuaucgagacgaaguucaccaaggagaaccucaauaagaagaccggcgaaaucacccgcaaggucgaaugguucgaguuagugcugccgaaggucuuauuugggcaggccguguucgacggcgggcagccguucauguuagggagcuccacguauccucacaaucugagggagcuggugcucaccaaggacagcgucaaaaagauagcggggaaggaguccaacaagagcuaccuggacgccuacgacgagaucauggaagccaugaacaaguauuuccccuuauacgacaccaacaaguucagggagaaggugaucgagggccgauccaaguucaucgaccuccccgacaaggacgaguacgagaauaacaaacuggugcaaguaggaaagagcaccaucaucgaccgcauguuuaucgggcugcacgcgaacgcagcgcggacggaccucaagaacaucggcaucaccacccccuucggguucaugcagcaggccuccggcaucaagcugaccaaggauaccguggugcuguuccagagcuccaccggccucuucgagcgcaaggucgcccugaaggaccuguga

SEQ ID NO: 7693 - RNA, 4077 nt, Artificial Sequence
  Cas9 variant
augaaagaacccuacggggucggccucgacaucggcacaaacaguguuggauggaccguaguagacgcgagcggccauguacgaaaaauuaaaggacagacgggcauagggguccgacuauucaaggaaggugccgcugccgcagacagacgcggauuccgcacgacccgacggcggcuuaaacgcguaaaauggcgccuccgacuccuccgggaguuuuucgaucagcccauuucuaaaguagauaucaacuucuucgcacgacgcaaguacagugacgucagcccccgagacccgaacuauaacggccuugagaagacccucuucaacgaccguagcgaucaagacuucuaccacgacuacccaaccaucuaccaccuccgcgaggcccugaugacccaacaccggaaguucgacguccgugagaucuaucucgccauacaucacaucguaaaguaucggggcaacuuccuucgaaaugacgccgcgacagccuaccgcucuggcacccucgacuuacagcagcauuucgaaacgcucaaccaccuauucucccaagcggaccuagaacucaacuuaaacuuaacaaccgacguggcucuccucgacuccauaaagcaaacccucguccgcacagacaucucccgcucggacaggcaaaaacucaucaugccacugcuagcaguacuaacgggagcuaccaccgcagaaaagaaaagacagaaggcgguagucacagaguucgccaaagcccucgucggaaacaaaaccaaaaucgacguacugacccucacagacaucgacgccacugaagccaaggacugggcauucucgcucgaggaaaaccaagacaagcuccccgggaucgaggaccgguucagcgaagucggucagcaaaucauagacgaaguuauacggcucuacgccucaguaaacuuagcccaacuuaucccagaagguaaacgguucagccaaagcaugguggaaaaauauaagcgucauggagaagaccucaaacuacuuaaggcuuacauccgcagccagagcgacgcuaaacggggccgcgccaucagggcaacauacgaccaauacauugauggcgucaaaucgaaacaagugacacaggaggcuuuccaaaaagcccucgggaaauucguagacgcugacgucgacuuaaacucaugggcugcccaaaucaaacaagcaauugacagcgaacaauuuaugcccaaacuacgaacaaagcaaaacggcgccauacccuaccaaguccaacagaacgaacucgaccaaaucaucucaaaucaaaaagaauacuacccuuggcucggagaagaaaaucccgucauaaaacgcaggggcaaguucccuuauaagcuagacgaacuauucggcuuccgcgugccauacuacguaggcccccucauuacaaaagaaaugcaagcggcaaccgccaacgccggcuucgccuggaugguccguaaggcggacggcccaaucacuccauggaacuuugacgacaaaguggaccgcguggcuagcgccaccgcauucauucaaaggaugcaaaccaccgauacguaccucauaggcgaagaaguacucccagcucgcagccuaaucuaccagcgcuucauggugcucaaugaacuaaacaacauucgcguagacgacggacaacucacgccccgacaaaaacaacgacuuuacaaccaaguguucaagaaacacaaacgaguuaccgccaaaaacauccaagacaaccuugucgcagcacgcgaguucccaacagcccccaggaucaccggccuggccgaccccaaaguauuuaauuccucacugucuaccuaucacgaccucaaacaaguccucccagaagcuaugucagacguaaggaaacaagcagacaucgagaaaauuauacuuuggucaacgaucuucgaagauaguaccaucuucaaacaaaaacucaccgaaauuagcuggcugaccgccgcacagcuaaaacaacuggggcaacuccgauaccggggauggggacaauuacuccgaaaacuccugacuggccuaaaagacgacaauaaccgcagcaucauggacggacuaugggaaaccaaugccaacuucaugcaacuccggagccagccagccaucgaaaaccagaucaaaucugcgaaccaagcaaaccucaccacagcagaucuccaagacacaaucaaugaacuuuacaccucgccccagaacaagaaagccauacgcgaaguaaugguaguccucgcagacauuaaagaugcuaugcacggacaaacucccaacuggaucuuuguagaagcagcaagaggaggaggcgucgcaggccggcgcacccaaucccguagcaaacaaaucgucgccgcauaccaaggcacggcccaagcuaucguccgagaccaaguccaacgcgaacuaaaggaaaagauuaaaaacaaagcuaacuucaacacccgccucguacucuacuuccuucaaaacggacgggaccucuacaccggagacgccauaaacauugaccgucugagcgaguacgacaucgaccacauauuaccccaaucauuaguuaaagacgacucccuagacaaccggguacuaacaaacgcacgcaucaaccgggagaaaaaugacaccuucgccuccgaaaaauuuggcaaaaagaugggagccaaauggaaagaaaugcacaggaugggauugaugaccaaacgaaagcuagaccaccuacucaugcgacccgacgaaauaagcaaauacgcaacaggcuucaucaacaggcaacuggucgagacucgccaagucaucaaacucgucgaagaacucaucaaugcagaguacccguccacagcaauaguuagcgugaaagccaaccuaacgcaccaauuccgccaaacguucgacuuccccaaaauccgcgaagucaacgauuaccaccacgcguucgacgcagcguugaccgcauucauaggaaccuaccugcuuaagcgguaccccaagcuagaacgcuucuuugucuacgguaaguucgcgaaacaaccaguaaaccucacccgcuucaauguaauccggaaacuugcaaaaacggauaccccaauuaccgacaucgacacaggcgaaguccucugggacaaacucacagacauaaaguacuucgaaacgcuauaugacuacaaacgacuacucgucacucgagaagucuccgagaacuauggagccauguucgaucagacccuucuaaaagcuagcgacaacggcaaacgccuaauacggaagaaacaauccuucgacacagccauuuacggcggauacaccgggaaaaccuuggccuacauggcaaucguaaaagucagcaccaagaaagacguacaauaccaagucgucggaguaccgaccaccauggucacccaaaucgaacaacuagaacaacaagguaugaccaacaaacaagccgucacuaaagucaucgagccccuaauagccgcaaauaacaagaaaaugcuaacauacgaaguucugcuccccaaaguacgcuucgaacaaguaguacgagaucgcauuaaaggccaaacucaccgguucgcacuaggcacggacacauacuaccacaacauccaagaacuauaucuaccccuaacacuccaacgcgcuuuccuagguaaacagaaugagagcgagguccaacuaaaucagaaccuccuuacgguguucgacgcuacccucgcccaaguaaaccgcuacuuuccccucuacgaaaugaacaaauucaagaaaauccugaacuccgcgcgggaccaaauagaacuucuggaggcgaaaaaccaguucgucaagaacaagcuaguacuggggaaacagggaauauuaacuaauauguucaucggacuacacgcaaacgcuucguauggcgaccucaaaguccucgggguaaagauugacuuugggaaacuccaaguccccggaggcauaaaacucaccggcgacgccgagaucaucuaccagucuccuaccggccuguucgaacgaaagaucgccuuaaaagaccucuga

SEQ ID NO: 7694 - RNA, 4077 nt, Artificial Sequence
  Cas9 variant
augaaugagccauacggcgucggccuggacauaggaacuaauagcguuggauggacgguagucgauaugaacggucguguacgaaaagucaaaggaaaaacagcucugggagccagauuguucaaagaaggagcaacugcagaagacagacgcggguuccgcaccacccggcggcggcugaaaagggucaaguggcgacuaagacuccugagagaguucuuugaccaaccuauaagcaaaaucgacccuaacuuuuucgccaggagaaaauacucugauaucagcccccgcgacccaaacuacaauggacuagcaaaaacucuguucaacgaccgaaccgaccaagaguucuaccacgacuacccaacaaucuaccaucugcgggauaagcuaaugaccagcgacaggaaauuugacauccgcgaaaucuaccucgccauucaccacaucgucaaauaccgggguaauuuccuccgcacaggcccggccucgcaauacggcuccgccucccuccaccucgcaaccuccuuucaaaaacuaaacgaccucuucgcccaaucagaagaaucgcugaacuucaaauugguaaccgacgaagcgcaacuccaacaaauacagcaaauccucgugcggacagaccucucccgcuccgaacagcaaaggcaaauauggccccugaugguaguacuaaugggagcgaccgccgcugaaaagaaaagacagaaggacuucgcaaaggaacucgccaacgcccuaguaggccucaaagcaaaacuaaacgucgugacccucaccaauguagauaccaccguggugaaagacuggacuuucacacuggaagaaucacaggacaaacuccccgaaauagaggaacaguuauccgaggucgggcaacaaaucauggacgaagucauccagcucuacgcgagcguuaaccuggcacaacucauccccgcaggcaaacgcuucucgcaacacaugguagaaaaauacaaccaccacgagaaaaaucuagaauugcuaaaggcuuacauacacucccaauccgacucgaaacgcggacgcgaaaucagagccacauacgaccgguacauagacggcguaaagucaaaacccgucacucaagaaauguucuacaaagaccucaugaaauacgucgaagcagacgcaacgucaaaccaccucgcggcagaaaucaaggaugaaauugacagcgaacaguuuaugccaaaacucagaaccaaacaaaacgguucaauacccuaccaaguucaacaauacgaacuagaccaaaucauaagccaccagaaaaaguauuauccauggcucggcgaggagaaccccguggcggaacgacgaggaaaauuuccauauaaacuugacgagcuaguaggcuuccgggucccauauuacguagggccgcuaaucacgaaagaagaucaacaggcaaccagcggggcuggauucgccuggaugguucgcaaagcggacggacccaucaccccguggaacuucgaccaaaaggucgaccggauagcuuccgccacagccuuuauccagcgcaugcaaaccaccgacacauaucuaauaggagaagacguccugccagcccgaucccucaucuaccaaagguucaugguacucaaugaacucaacaauaugagagucgaagaucaaaaacuugcccccagacaaaaacaacgccucuacaaccaaguauuuaagcagcaccaacacgucuccgucaaaaacauccagcaaaaccucauggacgcaggagaauacagagaaaccccaaaaauaacgggacuggcugaccccaaagguuucaacagcucccuaagcacuuaccacgacuucaaaaagauccucccagaagccaucgccgaugagcacaagagagccgacauagaaaagaucauucuauggucaaccaccuucgaggacagugccaucuucaaacaaaagcucgaggaaguagccuggcucaccgacgcacagcgcaaacaauuaagcgggcuacgauacagagguugggggcaauuaagccacaaacuccugaccgccuucaaggacgacaauggcagaagcgucauggacggacucugggagaccagcgacaacuucaugcaacucaggaagcaaccagcaaucgaaacacaaauuaaggaggcaaaccaagccaaccuaacugacgccgacauacaagacaccaucaacgaauuguacaccucgccacagaacaagaaagccauccgagaggugaugcucgugcuagacgauaucaaaaaugcgaugcacggacaaacgccaucuuggauauucauagaagcugccaggggcgggggcguagcaggccgcagaacccagagccgcucaaaacaaaucgucgaagcguacaagagcacugccaaagaaauaguuuccgaaaaggugcagcacgaacucaacgagaaaaucaaggcaaaagcugacuucaacacccgacucguacuauacuuccuacaaaacggcagagaccuguacaccaacgaagccaucaauauagaccgccuaucggaauacgacauagaccacauacuuccgcagucauuaguaaaagaugacucacuugacaaccggguacuaacuuccgcacgaauuaacagagagaagaaugacacuuucgcauccgaaaaauucggaagaaaaaugggcgcccaauggagagaacuucaucgcaacgggcuuaugacccaacgcaaacuuaaacaccuccuaaugaggccagacgaaaucuccaagcaugccaccgacuucaucaacagacaacucguggaaacccgacaaguaauaaagcucguagaagaacucaucuccucagaauaccccuccgccaguauagucgcaguaaaagccaaccuuacgcaccaguuccgccaaaccuucaacuucccaaaacugagagaggucaaugacuaccaccacgcauucgacgcgagccuaacggcuuucaucggaauguaccuccucaagcaauacccgaaacuggagcgauucuucgucuauggcaaauucgccaagcaacccaucaaccucacaagauucaacgucaucagaaagcuggcggucgcagaagaaccaaucgccaauauagagaccggagagauccuaugggacaaaacagcagacaucaaauguuucgaaaagcuauacaacuacaaaaggcugcuagucacccacgaagugagagagaacuacggcgcgauguucgaccagacuaucuucaaggcaaccgacucaaggaaacggcuaauccaaaagaagaaaggauucgcgaccgaaacauacggcggguacacaggucguacccuagcauaccuagcaauaguaaaaguaguaacaaacaaagacacccaauaucaaguagucggaauaccaacaacaaugguaacacaaauccaacagcuggaggcaagcggucugacauccaagcaggccgucacgaaagccauaggggcaaugauaaacgagaauaauaagaaacuacaaucguacgaaguccuuuuacccaaaguccgauucgagcaagucguacgcgacgaagucaaagggcacauccaccgguucgcccucgggaccgacaccuauuaccacaacauacaggagcucuaccuaccgcuaacaauccaacgcgcguuccucggcaaacgcaacgacaccgacgcccagacagaacaaaaucugcuaacaguauuugaaaccacgcuugcacagguaaacagauauuucccccucuacgaaaugaacaaguuuaaacaaauacuuaacucagcacaggagaaguucgccgcccucccaaccaaaaacaaaacugucaaaaacaaauugguuaccgggaaagacgguguacuaaacaaccuauucaucggucuacacgccaaugccucacugggggaccuaaaaauccuaggcaugaagaccggauucggcaaacuacagguacccggugggcugaaacuaaccgaccaagccgaaauaauauaccaaagccccaccggacuauucgagcgcaaagucgcacucaaggaucuguga

SEQ ID NO: 7695 - RNA, 4077 nt, Artificial Sequence
  Cas9 variant
augaacgagccuuacggugucggucucgacaucggcaccaauagcgucggguggacugugguagauaugaauggcaggguacggaaaguuaaggggaagacggcccucggcgcacgccuuuucaaagagggugcgaccgccgaggacagacgcggguuccguaccacgcgacgacgccugaagcgggugaaguggcgccucagacugcugcgcgaguuuuucgaccagccgauauccaagaucgaccccaacuuuuucgcccggcgcaaauauucagacauaucccccagggacccuaacuacaacggccucgccaaaacgcuguucaacgacagaacugaccaagaguucuaccacgacuacccgacaaucuaccaucugcgggacaagcucaugaccuccgaccgcaaauucgacauacgggaaauauaucuggccauccaccauaucguuaaguaucgaggaaauuuucugcgcacaggacccgcgucccaauacggaucugcgucccuccaccuggcuacgagcuuccagaagcugaacgacuuauucgcacaguccgaagagagccuaaacuucaaacuggugaccgaugaggcgcagcuccagcagauccaacagaucuuagugcguacagaccuguccaggagcgagcagcagcggcaaauauggccccucaugguagugcugaugggcgccacagccgccgagaagaaacgccaaaaggacuucgcgaaggagcuugcgaacgcucucguaggccuuaaagccaagcuaaacgucgugacacucacaaacguggauacgacgguagugaaggacuggaccuucacccuggaggagucccaagacaagcugcccgagauagaggagcaacuuagugagguggggcagcagaucauggacgaggucauccagcuguaugccuccgugaaccuggcccagcucauaccggcgggcaagcgguucagucagcacaugguggagaaguacaaccaccacgagaagaaccuggagcugcucaaagccuauauccacucccagagcgacuccaaacgugggcgagagauacgcgccaccuaugaccgcuauaucgacggcgucaagucaaagcccgucacucaggaaauguucuacaaggaucugaugaaguacguagaggccgacgccaccagcaaucaucuggcagccgagaucaaagacgagaucgacucagagcaguucaugcccaaacuacggaccaaacaaaauggcagcaucccguaccagguccagcaguaugagcuagaccagaucaucagccaucagaaaaaguacuauccauggcucggagaggagaaucccguagccgagcggcgcggcaaguuccccuacaagcucgacgaguuggucggguuccgugugccauacuacgugggcccacugauuaccaaggaggaucagcaggccacaagcggugccgguuucgcguggaugguaaggaaggcggacggccccaucacgcccuggaacuucgaccagaagguggaucgaaucgccuccgccaccgcguucauacagcgcaugcagacaacggauaccuaccucaucggcgaagacgugcuccccgcccggagcuugauuuaccaacgcuuuauggucuuaaaugaauuaaacaacaugcguguggaggaccaaaagcucgcaccgcgccagaagcagcggcuguauaaccagguguucaagcagcaccagcaugucuccgugaagaacauccagcaaaaccucauggaugccggcgaguaucgcgagacgcccaagaucacuggguuagccgaucccaagggcuucaauucaucccuaucgacguaccacgauuucaagaagauccuaccagaagccaucgccgaugagcacaagcgcgccgacaucgagaagauuauucugugguccaccaccuucgaggacagcgccauauucaaacagaagcuggaggagguagccuggcucacagacgcacagagaaagcagcuauccggguuacgcuacagaggcuggggacaauuaagccauaagcugcugacggccuuuaaagacgacaaugggcgauccguaauggacggccucugggagaccucggacaacuucaugcagcugcggaaacaaccggccauagagacccagaucaaggaggccaaccaagcuaaccugaccgaugcggacauccaggacaccaucaacgagcucuacacaucuccccagaacaagaaggccauucgcgaggugaugcugguacuagacgacaucaagaacgccaugcacggacagacuccauccuggauuuucaucgaggccgcccggggagggggcguagcaggccgccggacccaaucccguucgaagcaaauaguggaggcauacaaaucgaccgccaaggagauugucuccgaaaaggugcaacacgaauuaaaugagaaaaucaaggccaaggcggacuucaauacgcggcugguccuauacuuccuccagaacggaagggacuuauauaccaacgaagccaucaacaucgaucggcugagcgaauacgacaucgaccauauacucccccaaucccugguuaaggaugacucccuggacaaucgcguccugacauccgcccggaucaaccgcgaaaagaaugacaccuucgccagcgagaaguucggccggaagaugggggcccaguggcgcgagcuccaccggaacggacugaugacgcagcgcaagcucaagcaccuccuuaugcgaccggaugagaucagcaagcacgcuaccgauuucauuaaccggcagcugguggagaccagacaggugauaaagcuggucgaggagcugaucagcuccgaguacccaagcgcuuccauaguggccgugaaggcgaaccucacucaccaguucaggcagacguuuaacuuccccaagcuacgcgaagucaacgacuaucaucacgcauucgacgcgagccugaccgcuuucaucggcauguaccuccugaagcaguacccgaagcuggagagguucuucguguaugggaaguucgccaagcagccuaucaaccuuacccguuucaacgugauccggaaacuggcugucgcugaggagccaaucgccaacauugagaccggcgaaauccugugggacaagacugccgacaucaagugcuucgagaagcuauauaacuauaagcgcuugcuggugacccacgaggugagagagaacuacggugccauguucgaccagaccaucuuuaaggccacggacuccagaaagcggcucauucagaaaaagaaaggcuucgcgacggagaccuacggaggauacaccgggcgcaccuuagcuuaccuagccaucgucaaagugguuacgaauaaggacacacaguaccaggugguagggaucccgaccaccauggugacucagauccaacagcuugaggcaaguggacugacuuccaaacaggccgucacgaaggcuaucggagccaugauaaacgaaaacaacaagaagcugcagagcuacgaggugcugcugccgaaggugcgguucgagcaggucguacgcgacgagguaaagggccacauccaccgguuugcucuaggcaccgacacauacuaucacaacauccaagagcuguaccugccauuaaccauccagcgggcguuucucggcaagcggaaugacacagaugcccaaaccgagcagaaccugcugaccgucuuugagaccacccucgcccaagugaaccgcuacuuuccuuuguacgagaugaacaaguucaagcaaauucuuaauucggcgcaggaaaaguucgccgcccuccccacaaagaacaaaacagugaaaaacaaacuugucacgggaaaagacgggguccugaacaaccucuucauaggucuucacgccaacgcaagccugggagacuugaagauccugggcaugaagaucggcuuuggcaagcuccaggugcccggcgggcugaaacugaccgaucaggccgaaaucaucuaucagagccccaccggccuguucgagcgaaaggucgcccuaaaggaccuauga

SEQ ID NO: 7696 - RNA, 4077 nt, Artificial Sequence
  Cas9 variant
augaaagaaccauacggcgucgguuuggacaucggcacaaacagcguggguuggaccguagucgaugcgucagggcacguuagaaaaaucaagggucaaacgggcaucggcgugagacuauucaaagaaggcgcugcugcggcugaccgcagaggguuccgcacuacgcgaagacgacucaagcguguuaaauggcgucuacgucuccugcgagaauuuuucgaccagccaaucuccaaaguagauaucaacuucuucgcccgccgcaaauacagcgacauaagcccccgugaccccaacuacaacgggcuggagaaaacccucuucaaugacagauccgaccaagacuucuaccacgacuacccaaccaucuaccaccuucgggaagcccuuaugacucaacaccggaaauucgacgugcgcgaaauuuaccucgccauccaccacaucguuaaauacagaggcaacuuuuuacguaacgacgccgcaacugcauacaggagcggcacauuagaucuccaacaacacuucgaaacacuuaaccaccuauuuucccaagcagaucucgaacuaaaccucaaccucaccaccgacguggcgcuccuagauucuaucaaacaaacccugguacgcaccgacauuagccgcucagacagacagaaauuaaucaugccucuccuagcaguccuaacaggugccaccaccgcggaaaagaaacgacaaaaagccguugugaccgaguucgcgaaagcauugguagguaacaaaaccaagaucgacguacucacucugaccgacaucgacgccacggaagcaaaagacugggcuuucuccuuggaagaaaaccaagacaaacuaccaggaauagaagaccgcuucuccgaagugggccaacagauaaucgacgaggucauccgauuguacgccagcgugaacuuagcccaacucauccccgaaggaaaaagguucucccaaucaauggucgagaaauacaaacgccacggcgaagaccuuaaauuacucaaggcguacauccggucacagucagaugccaaacggggccgcgcuauacgcgcuacauacgaccaguacaucgauggugugaaaucaaaacaagucacccaagaagccuuucaaaaggcguuaggcaaauuuguggacgcagacgucgaccucaacuccugggcagcucaaaucaaacaagccaucgacagcgaacaguucaugcccaagcuacgaacaaaacaaaacggcgcaauccccuaccaaguacaacaaaacgaacuagaccaaauaaucaauaaccaaaaagaauacuaccccugguuaggcgaagaaaacccaguaaucaagcggcgagggaaauuccccuacaaacucgacgaacuugucggguuccgagucccauacuacgucggcccacuaaucacgaaggaaaugcaggccgccacagcgaaugcuggcuuugccuggaugguccgaaaggccgauggcccaaucaccccuuggaacuuugacgauaaggucgaucgcgucgcuucagcaacggcguucauccaacggaugcagacaaccgacacauaccuaauaggagaagaaguccugcccgcacgcucccuaauauaccagcgauucaugguccugaacgaacugaacaacaucagagucgacgacggccagcucaccccgcggcagaaacaacgucuauacaaccaagucuucaagaaacacaagagaguaaccgccaaaaacauacaggacaaccucguugcagcaggagaguuccccaccgcaccccgcauaacggggcucgccgacccaaaaguuuucaacucuagccucucaaccuaccacgaccucaaacaaguccuuccagaagcgaugagcgacgucagaaagcaggccgacaucgagaaaaucauccuguggucaacgauuuucgaagauagcacaauauucaaacaaaaacuaacagagaucuccuggcuaacugcagcucaacucaaacaacucggccaacuacgcuaccguggguggggacaacucucccgaaaacuucugacaggacucaaggacgacaacaaucgguccauaauggauggacucugggaaaccaacgccaacuucaugcaacucagaagccaaccugcaaucgaaaaccaaauaaagagcgcaaaccaagccaaccuaacaacugccgaccuccaggacacaauuaacgaacuauacacuucgccacagaauaaaaaggcaauccgcgaagugauggugguacucgcagacauuaaggacgccaugcauggucaaacaccuaacuggaucuucgucgaagcagcgcgaggagguggaguggccggccgacguacgcaaucacguaguaaacagauagucgccgcuuaccagggaacagcccaaguaauuguaucagaccagguacagagagaacucaaggagaaaaucaaaaacaaagcaaacuuuaauacccgacucguacuauacuuccugcaaaacggacgcgaccuauacacgggagacgccauaaauaucgaccgccucagcgaauacgauaucgaucacauccuaccccaaucccuaguaaaagacgacucccucgacaaccgggugcucaccaacgccagaauaaaccgcgagaaaaacgacaccuucgccuccgaaaaguucgggaagaaaaugggcgcgaaguggaaagaaaugcacagaaugggccucaugacuaaacgcaaacuagaccaccuccucaugcggccagacgaaaucucuaaguacgccacgggauucaucaaccgccagcuaguggaaacucgacaagugauaaaacucguagaagaacucauuaacgcagaauacccguccaccgcgaucgucucugucaaagcaaauuuaacccaccaauuccgacagacauucgauuuccccaaaauacgugaagucaacgauuaccaccaugccuucgacgccgcccuaacagcauucaucggcaccuaccugcucaagcgcuaccccaaacuagaacgcuucuucguuuaugguaaauucgccaaacaacccgucaaccucacuagauuuaacgugauccgcaaacuagcaaaaacagacacacccaucacagacaucgacacaggggaggugcugugggacaaacugacagacauaaaauacuucgagacccuauacgacuauaagcgccuccuagugaccagagaagucagcgaaaauuacggcgccauguucgaccaaacccuacucaaggccagcgauaacgguaaacgccugauacgaaagaaacaaucuuucgacaccgcgauauauggcggcuacaccgggaaaacccucgccuacauggcuauagucaaggucucaacgaagaaggacguucaguaccaagucgucggcguccccacaacaauggucacacaaauagaacaacucgaacagcagggcaugacuaacaaacaagcagucacaaaagucauagaaccacuaaucgccgcaaacaacaagaaaaugcuuacauaugagguacugcuucccaaaguacgauucgagcaaguaguccgggaccggauaaaaggacaaacccacagauucgccuuaggcacggacacguauuaccacaacauacaagagcuguaccuaccccuaacacuccagcgagcuuuucucggaaaacaaaacgaaucggaaguccagcuaaaccaaaaccuccucacugucuucgaugccacacucgcccaagucaaccgguacuucccacuguacgaaaugaacaaauucaagaaaauacucaacagugcaagagaccaaaucgagcuccuagaagccaaaaaccaauucgucaagaacaaacucguacucggcaaacaaggcaucuugaccaauauguucauaggccugcacgccaacgccagcuuuggcgaccucaaaagccuugguguuaaaaccucuuucggacaacuccaaguccccggcggcauaaaacuaacgggcgacgcagaaauaaucuaccaaucaccaacgggacucuucgagcgaaaaauagcucuaaaggaccucuga

SEQ ID NO: 7697 - RNA, 4077 nt, Artificial Sequence; identical to SEQ ID NO: 1897
  Cas9 variant

SEQ ID NO: 7698 - RNA, 4077 nt, Artificial Sequence; identical to SEQ ID NO: 1898
  Cas9 variant

SEQ ID NO: 7699 - RNA, 4083 nt, Artificial Sequence
  Cas9 variant
augaccaagcugggcaagcccuacgggaucggcguggacaucggaagcaacuccaucggcuucgccgccgucgacgaaaacagccaccucauccggcugaaggguaagaccgugaucggcgcgcggcuguucgaggagggcaaggccgccgccgaccgccgggcuucccgcacgacccggcgcagacucagccgcaaccgauggcgacuguccuuccugcgggacuucuucgagagccacaucaccccgaccgaccccaacuucuucaugcgccagaaguacuccgagaucagccccaaggacaaggcgcgguacaaguacgagaagcgccucuuuaacgaccggacggacgccgaguucuaccagcaguaucccaccauguaucaccuccgcacccggcugcugaccgacccguccaaggccgacgugcgcgagaucuacuucgccauccaccacauccucaagagccgggggcacuuccugacguccggcuacgcgaaggauuucaacaccaacaaggucgcccugaacgagaucuuccccgcccugcaggacgccuacgcccagguguaccccgaccuggacaucaccuucgacgagaacaaggugaacgaguucaaaaccguccuccuggacgagaaggcgacgcccagcgacacccagcgcgcccuggugaaccuccugcuggccgaggacggggauaaggacauccucaagcaacagaagcagguccugaccgaguucgccaaggccguggugggccugaagaccaagcucaacguggcgcuggggacggaggucgacuccagcgaggccaccgccuggaacuucucccuuggccagcucgacgacaaaugggccggcaucgagagcgccaugaccgacgagggaaccgagauccucgaccagauccgggaccuguaccgcgcgcgccucuuaaacggcaucgugccggccgggaaaacgcugucccaggcuaagguggacgacuacgagcagcaccacgaggaccucgagcuguuuaaggacuaccugaagcagcucgaggacgacggcauggccaaggccauccggcaguuguacgaccgcuacaucgacggcgacgacgcgaagcccuucguccgggaggacuucgugaaggcgcugaccaaggaggugaccgcacaccccaacgccaagagccccgagcucuuagagcgccugguccagccggacuucaugcucaagcagcggaacaaggcgaacggggccauccccgugcagaugcagcagcgcgagcuggaccagaucaucaagaaccaguccguguacuaugacuggcuggccgcccccaacccagucgagaagcaccggcagagcaugccuuaccaguucgacgagcuccugaacuuccgcauccccuacuacgugggcccccuggugaccgccaaggagcagaaggcggcccaaggcggggucuucgccuggauggugcggaaggaccccgacggcaacaucacgccguacaacuucgacgagaaggucgaccgcgaggccagcgccaacaccuucauccagcggaugaagaccaccgacacguaccucaucggcgaggacgugcugcccaagcagucacugcuguaccagagcuacgaggugcucaacgagcugaacaacguccgcgugaacgacaacaagcugucuuucgaucagaagcagcagguccuaggcgagcuguucgaacggcacaacaccgugaccaucaagcaguucguggacaaccugcucgcgcacggggacuacgaccgcauccccgaagugcggggccuggccgacgagaagcgcuuccugaguucccucagcaccuacaaccagcugaaggggauccugcacgaggccaucgacgacuccgacaagcagacggacaucgagaagaucaucgccuggagcaccaucuucgaggacaaggccaucuucaagaccaagcucaacgagaucuccuggcugaacgcgggcaugaucaacagccuggccaacauccgguaccgcggguggggccaguucucccacaaacuccugaacgagcugacccucagcacgggccggaccgucuucgaggaacugcugaucuccagccacaaccucaugcagauccugaccgacgaggugcugaagcaaaagaucgccgagcucaacgcccacgagcugaaggcguccgggaucuaugccgcuaucgacgacgccuacaccagccccuccaacaagaaggcccugcgccaggugcucuccgucaucgacgacaucaccaacgccgccgggcaggccccgaacuggcuguacaucgagacggccgacggggacggcgugcccgggaagcgcaccaacucccggcaacgcaaaauccaggagaucuacgugaacgccgcgcaggagcugaucaccggcagcguccggggcgagcuugaggacaagaucgcgagccgcgccgacuucaccgaccggcugguccuguacuucaugcagggcgggcgcgacaucuacacgggggagccccucaacaucgacaaccuguccagcuacgacaucgaccacauacuuccccagucccucaucaaggacaacagccuggacaaccgggugcugguccacccgcucgugaaucgcgagaaggauaccaucuucgccuccacccgguucgccaagcagaugaacggcauguggcgccaguggcacgcggccggccugaucagcucccggaagcugcgcaaccuccagaugcggcccgacgagaucgacaaguacgccagcggguucguggcccgccagcuggucgagacccggcagaucauaaagcugacggagcagaucguugcggaccaguaccccgacgcuaagaucaucgccgugaaggccggccucuccagccagcugcgcaaggagcuggacuucccgaagaaccgggaggucaaccacuaccaccacgcguucgacgcguuccucgccgcccgcaucgggaccuaccugcugaagcgguaccccaaccucgagcccuucuucaccuacggcaaguucaagaagaccgaggugaagaagcugaaguccuucaacuucauccgcgacaugacgcacgccaaggacaagaucgucgcuaaggagaccggggagaucgucugggacaacgcgagcgacaucaacgaguuagacaggaucuacaacuucaagcgcaugcucaucacccacgaggugcgcuucgagaccgccucccuguucaaacagacgcuguacgccgccaagaacagcaagaaccggggcggcucccgccagcucauccccaagaagaagggguaucugguggauaucuacggaggguacacccaggagaccggcagcuaccuguccgucgugcggcucaccaagaaggcaauguacgccgugguuaaggugaguacgcgcgacgccgccaagcuggccguggccaagagcaucucugagcagaaggagaacgagacacugaagaagaucaucgacgggaagcucaguaagaccuccaagaagggcaagaccacgcaccagcuguucgagaucguccugccgcgggugggccagaagacccucuucaagaacagcaaauacaaccaguuccuggugaacuccgacaccuacaugcacaauuaccaggagcuuuggaugccccgagaguaccagcggauguggaaggacauccuccugagcaaccacggggacgcgcagcuggagggccagcucgaccaaaucuucaaguucaucgucucccaggugaacagcuacuucaaccuguacgacaucaaccaauuccgcaagaagaucgccgacgccaccgacaaguucgccaagcugcccacgcacgacaccgacaacgcgcgggggaagaucgccaccaucggccagcuccugaucgggcugcaggccaacgcuaugcgcuccgaccuccggaaccuggacaucaagacccccuucggccugcuccagaucggcacggggauuacccuggaccuggacaccagcaucaucuaucaguccccaaccggccucuucgagcgcgaggugccccugacggaccuguga

SEQ ID NO: 7700 - RNA, 4083 nt, Artificial Sequence
  Cas9 variant
augaccaagcugaaccagcccuacggcaucgggcucgacaucggcagcuccagcaucggauucgccguagucgacgccaacagucaccuccugcgccucaagggcgagaccgcgaucggggcccggcuguuccgcgagggcgaaagcgccgccggccggcgugccucccggacgacccgccggaggcugagccacaaccgguggcgccuccgguuccugcaggacuucuucgauccgcacaucuccagcaucgaccccgacuucuuccugcgccagaaguacucugagauuagcccuaaggacaaggaacgguuuaaguaugagaagcgccucuuuaaugaccggaccgacgcgcaguucuacaagcaguaccccaccauguaucaccuccgccugcaccucaugaacgacgccuccaaggccgacccgcgggagauauucuucgccauccaccacauccucaagagccgcgggcacuuccugacgcccggugacgcgaagaauuucaacacggacgacguggaccucaagcacaucuucccagcacugaccgaggccuacgcccaggccuaccccgaccugacccucuccuucgagccaagcaaggcggagaaguucaaguccauccugcucgacgaggacgccacgagcaacgacacccagaaggcccucguaaagcuacugcucuccgacgauggcgacaaggagguccuaaagcagcagaagaaaguucugacagaguucgccaaggccguggcgggccuuaaggucaaguucaacguggcacuggggauagaggugaccgacgcugacgucgagaaguggcauuucggcauggcccagcuugaggacaaauggagcgacaucgaacccucccucacggaccagggcauggaaaucuucgagcaaauccaagaccuguaccgggcucgccugcucaacgggaucgugcccgcgggaaaaacucugagccaggccaagguggacgacuacgaccagcacugcaaggaccugaagcuguuuaaagaguaccucaagcaguugaacgaccaugaccucgcgaagcggauccgccugcuguacgaccgcuacaucgacggggacgacgccaagcccuuccuccgggaugacuuugucaaggcccugaagaaggaggugacagcgcacccgaccgagcuggccgagucccuccuggagcgcauggagcaagacaacuuuauguugaagcaacggacaaaggccaacggcuccauucccgugcaaaugcagcagcgcgaacuugauaagaucaucgccaaccaggcggaguacuacucguggcuggccgccgagaaccccgucaaggagcaccgggacuccaaaccguaccagcuggacgagcugcucaacuuucgcaucccguacuacgugggccccaugaucaccaagaagcagcaggagaaguccgggcagaacguguucgccuggaugguccgaaaggaccccaguggcaacaucacccccuacaacuucgacgaaaagguagaccgcgaggccagcgcgaacgccuucauccaacggaugaagacaacggacaccuaccugaucggggaggacgugcugccgaaacagagucuccucuaucagaaguacgagguccugaacgagcucaacaacgugcgagugaacggugagagccuguccaccgaccagaaaaagcggcugauccgcgaacucuucgagcggcacagcagcgucacccugaagcaguucguggagaauuugguagcucacggggacguggccaaacgccccgaugugcggggccucgccgacgagaagcgcuuucuaagcucccugagcacguaccaccagcuucggggcauccugcacgacgcgauagacgaccgcgggaaacaguccgacaucgagaacaucaucaccuggagcacggucuucgaggacgccuccaucuucaagagcaagcugggcgaaaucuccuggcucgacagcaagacccggaccacccugagcaacauccgcuaccgcggguggggccaguucucccgaaagcugcucgacgggcugaaacugggcaauggccacaccaucauccaggagcucaugcugagcucgcgaaaccucaugcagauccucaccgacgagacgcugaagaaggagauggccacccugaaucaagagcggcucaagcccgacagcaucaacgaggccaucgacgccgcguacaccucccccagcaacaaaaaggccauccgccagguguuaaagguggucgaugacaucaagcacgcagcgaacgaccaggcgccgucauggcuguacaucgagaccgccgacgggggcgggcauccgggcaagcgaacgcucagcaggcagaagcagauccaggccaucuacgagaauaccgcgaaggagcugaucgauuccgccgugcguggggagcugaaggacaagaucgcggacaagaccaacuucagcgaccggcucguucuauacuucaugcagggcggccacgauaucuauaccgggaccgcccugaacaucgaccagcucucaagcuacgacaucgaccacauccugccccagucccugaucaaggacgauagucucgacaaccggguccuagugcaugccaagaucaaucgcgagaaaaacgccgaguucgccuccacgcuauucgcggccaagauggccagcaccuggcaccgguggcgcgacgccggccucaucuccgggcgcaagcugaagaaccugcucaugcgccccgacgagguggacaaguaugcgaagggauuugucgcgcggcagcuugucgagacccgccaaaucaucaagcugaccgagcagaucguggcugcacaguaccccgacacgaagaucaucgccgucaaagcgggccucagccaccagcugcggcaggagcuggacuuccccaaaaacagagacgugaaccacuaccaccacgcauucgacgcauuccucgccgcccggaucgggacauaccugcugaagcgcuaucccaaccucgcgcccuucuucaccuacggcgaguucaccaagacgaaucugaagaagcugcagagcuucaacuucauuggggcccucacccauaccgacgggaagaucaccuccaaagauacgggggaggugcugugggacaaccagcgggacaucgaggaacuggaccagaucuacaacuuuaagcgcaugcucaucacccacgaggucuacuucgagaccgcgggccuguucaagcagaccguguacgccgccaaagacagcaaagagcgcggugguagucggcagcugauccccaagaaaaagggcuacagcacggggaucuauggcgguuacacccaggagacuggcuccuacaacgcgcucgugcgccugaccaaggccggcaaggucguguaccggguguucaagaucagcacgcagaacgccgcugagaucgccgcugcccgcucccucagcgccgaggaggggaacgagcggcucugccagauccuggagcagagccuacucaagaccaauaaggacaagaagaacaccgucgaccuguucgaugucgugaucccccgcuuaggcaaggaggcccucuuccacaacucuaaguacggucuuuuucuggucaacuccgacacauacuaccacaacuaccaggagcucuggcugagccgggagaaccagaagauccugaagaagcuguucucuacgaaguacgaccagagcgagauggaccgcgaugcccugcaucuguucgagaccauagcgaagcagguugagcaguucuucaagcucuacgacauuaaccaauucaggacaaagauuucaagcgccuucgacgcuuucgagaaguuacccguggagggggaggaggggaaggucgagacccugaagcagcuccugauuggccugcacgccaaucccgugcgcuccgaccucaagaaccuaggcaucaagacgcccuucggguuccugcaggcgggaaagggaauccaucucgacgacgacaccgagaucauccagcaaagccccgccggccuguuuaagaggcgcgugcggcuggccgaccuguga

SEQ ID NO: 7701 - RNA, 4086 nt, Artificial Sequence
  Cas9 variant
augaccaaacucggcaagcccuacgguaucgguguagacauuggaagcaacucaauaggcuucgccgccguagacgaaaauucgcaccucauaagacuaaaaggcaaaaccguaauaggggcccggcuguucgaggagggaaaagccgccgccgacagacgagcgaguagaaccacaagacgccgccucucccgcaaucgauggcgccucagcuuccuaagagacuucuucgaaagccacauuacacccacaggccccaacuucuuuaugagacaaaaauacagcgaaauaagcccaaaggacaaggcccgguacaaauacgaaaaacgucuauuuaacgaccgcacugacgcggaguucuaccaacaauacccaaccauguaccaccuccggaaccgccugcuaaccgaccccuccaaggcagacguccgggagaucuacuucgcaauacaccacauacuuaaaucaagaggucacuuucuaacguccggauacgcgaaagacuuuaacacuaacaaaguagcccugaacgaaaucuuccccgccuuacaggacgcguacgcacaaguauacccagaccuagacauaaccuucgaugaaaacaaggucaacgaauuuaagacaguacugcuaaacgaaaaagcgacgcccucagacacccaacgagcccuggucaaccuacugcucgccgaagacggggacaaagacauacuuaaacagcaaaagcaagugcuaacagaguucgcgaaggccguagucggccuuaaaaccaaacucaacguagcguuggggacagaaguggacuccucugaagcaaccguguggaacuuuucacucggacaacucgacgacaagugggccgggauugaaagcgccaugacugacgaaggcacagaaauccuagaccaaauaagggaccuauaccgcgcccgccucuuaaacggcauuguccccgccggcaaaacccucucccaggccaaggucgaugacuacgcccaacaucaugaggaccuagaacuauucaaggacuaucucaaacaacuagaagacgauggcaccgcgaaagcgaucagacagcuguacgaccgcuacauagacggcgacgacgcaaagcccuucgucagagaagacuuugucaaagcccuaaccaaggaaguaaccgcacaccccaaugccaaguccccagaacuccuggaacggcucgcccaaccagauuuuaugcucaaacagagaaauaaagcaaacggagccauccccguccagaugcaacaaagagaacuggaccagaucaucaaaaaccaauccguauacuacgacuggcucgcggccccaaaucccgucgaaaaacauaggaaguccaugcccuaucagcuggacgaacuacucaacuuccggauaccguauuacguaggaccacucguaacggcuaaagaacagaaagcagcccagggcggaguuuuugccuggaugguacgaaaagaccccgacggcaacaucaccccuuacaacuucgacgaaaagguagaccgggaggcaucagcaaacaccuucauccagcgcaugaagacaaccgacaccuaccucauaggggaagacguccucccaaagcaaucccuccucuaccagcgcuacgaaguucuaaacgaacuaaacaacguacgagugaacaacgaaaagcucucaauugaacagaaacaacaaguaauaagagaacucuuugaacggcacaauuccgucacgaucaaacaauucgccgagaaccuaagggcccacggcgacuacgcgcacauaccugaaaucaggggacucgccgacgagaagagauuccuaucuagccucucaacauacaggcaacuaaaaagucuccuaccggacgcaaucgacgaccccgccaaacaggccgacauagagaacaucauugcaugguccacaguauuugaagacgcggcgaucuucaagacaaaacuaaaagaaaucaacuggcucgauucgcaaaccaucacaaaacucagcaacauccgcuaucgaggauggggccaguucucacacaaauuccucaauggccuuacgcucggcaacggccacacaaucauacaggaacuauuucuaagcaacaacaaccuaaugcaaauccuaacagacgagacccuucaaaagaaaaugacagaacugaacgcagacaaacucaaagcugcaaacauaaacgacgcaauagaugaugccuacacaagccccucgaacaagaaagcgcuacggcagguccuacgagucauagaggacaucaagcgagccgcggauggccaagacccuucuuggcucuacguagaaaccgcagacggaggcggaaccccaggcaaacgcacccgugcgagacagcaucaguuacaagaaauauacgcgaacgcagcccacgagcugaucgacagcgcaguccggggcgaacuagaggacaagaucgccgacaaagccgacuucaacgacagacuugugcuauacuuuaugcaaggaggacgagacaucuacaccggcaccccacuaaauauagaccaacucaguucuuacgacaucgaccacauacucccccaaucccucauaaaagacaacucacucgacaaucgaguauuaguccacgcaaucauaaacagggaaaagaaugccacguucgccaguacaauauacgcgcagaagaugaacgcaacguggcgccaauggcaugaagccgggcucauaagcggaaggaaacuacgaaaccuucaaaugcgaccugaccagaucgacaaguacgccuccggcuucguggcccggcagcugguugagacgcggcagauaauaaaguuaaccgaacagaucguagcagcacaguaccccgaaacaaaaaucaucgccgucaaagcagggcuaucacaccaacuacgagaagaacuagaguuccccaaaaaccgggacguaaaccacuaucaccaugccuucgacgccuuccuugccgcucguauaggaaccuaccuccugaaacguuuucccaaccuucaggccuucuucacauacggcaaauucaagaaagcggacguaaagaaacugagaggcuucaacuucauacgagacaucacccaugccgaagacaaaaucguaguaaaggauaccggagaagucaucugggacaaaaagagagacguggacgaacuagacaggaucuauaacuucaaacgcaugcuaaucacacacgaaguacacuucgaaaaagccgaccuguucaaacagacgguguauggcgccaaagacucaaaagaggccgggggcaagaaacagcuaaucucuaagaagaaaggauaucccgucgauauauaugggggcuacacucaggagacaggcaguuaucucagcguaguuagacucaccaagaaagcaauguaugcgguaguaaaaguguccaccagagacgcagcgaaacuggcaguagccaaaucuauaagcgaacaaaaagagaacgaaacauuaaacgacauaaucgacgagaaacucuccaaaaucuccaaaaacgggaaaauaacccacgaacucuucgaaguuguccuaccccgcgucggccagaaaacucuauucaagaacucgaaguacaaccuauuuuuaguaaacucagauacauacaugcacaacuaccaagaauuauggaugccccgcgaauaucaaaagauguggaaagacaucucacugucaaaguauggcgacgcccaaacugaagaucaacucgaccaaauauuuggcuucaucguuucccagguaaacuccuacuucaaccucuaugacauaaaccaauuccgcaagaaacuaaacgacgcagccgacaaauuugcaacccuccccaugcgagauaccgacgacaugcaaggcaaaaucgcgacuaucggccaacuccugaucggucuccaagcgaaugccgcccgaagugaccuacgcaaccucgauaucaaaacaccccucgggcuucuucagauacccaacggcaucucgcuagauagcgacaccuccguagucuaccaaagccccaccggacugcuagaacgggaaguacaucucagcgaccuauga

SEQ ID NO: 7702 - RNA, 4086 nt, Artificial Sequence; identical to SEQ ID NO: 1902
  Cas9 variant

SEQ ID NO: 7703 - RNA, 4086 nt, Artificial Sequence; identical to SEQ ID NO: 1903
  Cas9 variant

SEQ ID NO: 7704 - RNA, 4086 nt, Artificial Sequence
  Cas9 variant
augacgaaacuuaaccaaccauacggcauaggacucgacaucggcucaaacaguauagguuucgcagucgucgacgcgaacagucaccuacuccggcucaagggagaaacggccaucggcgcccgccuauucagggagggacaauccgccgccgaacgccgcgaaagcagaacgaccagacgccgccuaucacgaacgcgcuggcgacucucauuucuucgcgacuucuucgcaccccacaucaccaaaaucgacccggacuuuuuccuaagacaaaaauacagcgaaauaaguccgaaggacaaagaccgcuucaaauacgaaaagagacuguucaaugaccgaaccgacgcugaauuuuacgaagacuacccuucaauguaccaccucaggcugcaccucaugacccacacgcacaaagccgacccgcgcgaaauauuucuagccauacaccacauacugaaaucacguggccacuuccucaccccgggugcagcaaaagacuucaacaccgacaaaguagaccucgaagacaucuucccggcccucaccgaggcuuaugcccaagucuacccggaccucgagcucacauuugaccucgcuaaggccgacgauuucaaagccaaacugcuggacgaacaggccacacccucagacacccaaaaagcccucgucaaccuucugcuaucaagugauggcgaaaaggaaauugucaagaaaagaaaacagguacucaccgaguucgccaaagcaauaaccgggcuaaaaacaaaguucaaccuagccuuaggcacagaagucgacgaagccgacgcaucaaacuggcaguucuccaugggacaacuugacgauaaauggagcaacaucgaaacaucgaugacagaucagggaacagagaucuucgaacaaauccaagagcucuaccgcgcacgucugcucaacggcauuguucccgcagggaugagccuuucacaagcaaaggucgccgacuacggccaacacaaagaagacuuagaacucuucaagaccuaccucaagaagcugaacgaccacgaacuggcuaaaaccauucgcggccuuuaugacagauauaucaacggggacgacgcaaaaccauuccuccgcgaggauuuugucaaagcccucacaaaggaggugacugcacaucccaacgaagucagcgaacaacuacuuaaccgcaugggacaagccaauuucaugcucaaacaacggaccaaagcaaacggugccauaccaguccaacuccaacaacgcgaacucgaccagauaaucgccaaucaaucgaaauacuacgacuggcuagcaaaacccaacccgguggagaaacaccgagcgagcaaacccuaccaacuugacgaacuacuuacguuccgaauaccauacuacgucggcccccucauaacaccgaaagaacaagccgagucgcgggaaaacguguuugccuggaugauccgaaaggacccuucggggaacauuacccccuacaauuuugacgaaaaaguggacugccccgcuucggcaaacauguucauacaacggaugaaaaacacugacacauaucucaucggggaggacguccucccaaaacgcucacuacucuaccaaaaauaugaaguacuuaacgaacucaacaacguguccaucgauggccgacgccuaggagccgaucagaaacaacgacugaucagagaggucuucgagcgacacucaucgguaaccauaaagcaaguagccgaaaauuuaguagcucauggcgacuucgcgaaacggccggaaauccgaggccucgccgacgagaaaagauuccuaaguuccuuaucaaccuaucaccagcucaagaaaauccuccacgaagcuaucgacgacccaaccaaagaacacgacauagagaauauaauaaccuggucaaccguauucgaagacgcagccauauuuaagaccgagcuggcuaaaaucagcuggcucgacucugacacgauaaaggcacugaguaacaucagguaccgggguuggggccaauuuucacgaaaauuacuagacgggcuaaaguuaggaaacggacauaccguuauccaagaacugaugcucucaaaccacaaccugaugcagauacucaccgacgaaacccuaaaaaccacaauggcagagcucaaccaagacaaacugaaggcugacgacauugaggaugucauaaacgacgccuacaccucacccagcaauaaaaaggcccuacgucaaguccuacgaguugucgaggacaucaaacacgccgccaaugggcaggacccaucauggcuauacaucgaaacagcagauggucccggaacugcgggcaagcgcacgcaaucacgacaaaaacaaauccagaccguauacgccaacgcggcucaagaacucauagacuccgcgguacgcggagagcucgaagacaagaucgcagacaaggccagcuucacagaccgccucguguuauacuucaugcaagggggacgcgacaucuacaccggagcuccacuaaacaucgaccagcuaucccauuacgacauagaccacauucuaccccaaagccucauaaaagacgauucccuggacaacaggguacugguaaacgccaccauaaauagagagaaaaacaacgucuucgcaucaacccuauucgccucuaagauggccgcaacguggcgaaaauggcacgaagccggacuaaucucaggccgaaaacuuaggaaccucaugcugcgucccgacgaaaucgacaaauucgcccauggcuucgucgcccggcaacucguagaaacccgacaaaucaucaaacuaaccgaacaaaucgcagcagcucaauacccgaacaccaagauaaucgcaguaaaagcaggcuugucacaccagcuacgugaggaacucgacuucccaaagaacagggacgucaaucacuaccaccacgcauucgacgcauuccuagcugcgcgaaucggcaccuaccuccucaagcgauaccccaagcucgcccccuucuucaccuacggagaauuugccaaggucgacgucaaaaaguucagagaguucaacuucaucggagcacucacccacgccaaaaagaacaucguagccaaagacacuggagaaauugugugggacaaagaacgcgacauacaagagcucgaucgcauauacaauuucaaacgaaugcuuauaacgcacgaaguuuauuucgagacggccgacuuauucaagcaaaccauuuacgcggcaaaagacucgaaggaaagagggggaucgaaacagcucaucccaaagaaacaaggauauccaacccagguguacggcggauacacaagagaaaacaccgcguaucuagccguagugaaaacagucgaaaagaaagcagacguauaccgggugguacguauagcaacuagccaagucgcagcccucaaggaagcacgugcccaguccacgguaaaagaacgcgaacuccucaagaaguuucucaccaccaaauucacgaaaauugguaaaaacggcaagaaagccauaacacccuuugacaucguuauaccccgagugccccgagaacagcuguuccacaacaaacgauacgguuucuucauggucaacuccgacacccuaaugcauaacuaccaagagcuauggaugucccgcucugaccaacaaauucucucuaaacucguuaaaucggccaaaacggucgagaauggccaagucggccgccucuucgaaaauauugucgagcaaaucaacaaguacuucccccuauaugacaucaaccaguuccggaaaaagcucgaccaguccaaggacaucuucucuaaacuaccccuagaaggaaacggaacuaccucagggaaacgcgaaaccauccaaaacauacucaccggcgccggaaccggcgccaaaaacggugaccucaaaaacuuaggcauaaaaaccccauucggcuuccuccaagugccgagcggcauaguacuggacgacgacaccacacugauauaccaauccccaacaggaaugcucaaccggauagugcgacuauccgaacuguga

SEQ ID NO: 7705 - RNA, 4086 nt, Artificial Sequence; identical to SEQ ID NO: 1905
  Cas9 variant

SEQ ID NO: 7706 - RNA, 4086 nt, Artificial Sequence
  Cas9 variant
augaacgagccguacggagucgggcuggacaucggcacuaacagcgucggguggacugugguggacaugaacggccgcguccggaaaguuaaggggaagacggcccucggcgcucgccuguucaaggagggcgcaaccgccgaggaccggcgcggguuccgcaccacccgucggcgcuugaagcggguaaaguggcgccugcggcugcugcgcgaguuuuucgaccagcccaucuccaagaucgaucccaacuucuucgcccgcaggaaguauagcgacaucucaccccgggacccuaacuacaacggccuugccaaaacguuauucaacgaccgcacggacaaggaguucuacgacgacuacgccaccaucuaccaccuccgggacaaauugaugacauccaaucgcaaguucgacauccgggagaucuaccuggcgauacaccacaucgucaaguaccggggcaauuuccugcggacgggcccggccucccaguacgggagcgcgagucuccaccuggcaaccagcuuccagaagcugaacgaccuauuugcccaguccgaagagacccugaaccugaagcucgugaccgaugaggcguuacugcagcagauucagcagauccucgugcgcaccgaccuaagcagguccgaacagcagcggcagaucuggccccugauggccgucuuaacuggcgcaagcgcugcggagaagaagcgacagaagaacguaguggucgaacugucaaaggcccuggugggcuuaaaggccaagaugaacguggucacucuaaccgagguggacgccgccgucgucaaggacuggacguucacuauggaggagagccaggauaagcugccagagaucgaggagcagcuguccgagguggggcagcagaucauggacgaagucauccagcuguacgcgagugucaaccuggcacagcucauccccgccgguaagcgcuucucgcagcacaugguggaaaaguacaagcaccacgaaaagaaccuggaacugcucaaggccuacauccacagccagucagacagcaagcgcgggcgggagauccgcgccaccuaugaccgguauaucgauggcguggauagcaaaccggugacccaggagauguucuacaaagaccugaugaaguacguagaggcggacgcaaccucuaaccaccuugccgccgagaucaaagacgagauugacagcgagcaguucaugcccaagcuccgaaccaagcaaaacggcuccaucccauaccagguacaacaguaugagcuugaccagaucaucagccaccagaagaaguacuaccccugguuaggggaggagaacccgguagcugagcggcgcggcaaguucccguauaaacuggacgaacuggugggguuccggguccccuacuacguggguccccugaucaccaaggaggaccagcaagcgaccuccggcgccggcuucgccuggaugguccgcaaggccgacgguccgaucacacccuggaacuucgaccagaaagucgaccguaucgcgagcgccaccgccuucauccagcgcaugcaaaccaccgacacguaccucaucggggaggacgugcuccccgcccggucucuuaucuaccagagauucaugguucucaacgaacugaacaacaugcgggucgaggaccgcaaacuggcuccccagcagaagcagcggcuguacaaucaaguguuuaagcaacaccagcaugugucggucaagaacauacagcagaaccucauggaugccggugaauaucgcaagacgccgcagauuacaggacuggccgaccccaagggauucaacaguagccuguccaccuaucacgacuucaagaagauccuccuggaggcuaucgccgacgagcacaagcgcgccgauaucgagaagaucauacuguggagcacgaccuucgaggacuccgcgaucuucaagcagaagcuagaggagguggccuggcugacagaugcacagcggaagcaguuaagcgggcugagauaucgaggcuggggccagcugucccacaagcugcuaaccgcguucaaggacgauaagggaaggagcaucauggacggccucugggagaccucagacaacuucaugcaacugaggaagcagcccgccauagagacccagaucaaggaggcaaaccaggcaaaccucaccgacgcggacauccaggacaccaucaacgagcuguacacaagcccccagaauaagaaggcgauccgagaggugaugcugguauuagaugacaucaagaacgcgaugcacgggcagaccccguccuggauauucguggaggccgcacguggcggugggguggccgggcgccgcacgcagucucgaagcagucagaucgucgaggccuacaaggggaccgcuaaggagauugugagcgagaagguucagcacgagcugaacgagaagaucaaggcgaaggccgacuucaacacccggcugguccucuacuuucugcagaauggccgcgaccuguacaccaaugaggccaucaacaucgaccggcucuccgaguacgauaucgaccacaucuuaccccaaagccucgugaaggacgacucucucgacaaccgcgugcuaacuucugcaaggaucaaccgcgagaagaaugacaccuucgcguccgagaaguucgggcgaaagaugggcgcgcaguggcgagagcugcacagaaacgggcucaugacacagcgcaagcugaaacaucuccugaugcgacccgaugaaaucagcaagcaugccacggacuucauaaaccgccaauuagucgagacccgccaggugauuaagcugguggaggaacuaaucaguagcgaguaccccgccgccagcauagucgccgugaaggccaaucugacgcaccaguuucggcaaacguuuaacuucccuaagcugcgggagguaaacgacuaccaccacgccuucgacgccagccucaccgcguuuaucgggauguacuuauuaaagcaauaccccaaacuugagcgguucuucgucuacggcaaguucgccaagcagcccaucaaccuuacccgguuuaacaucauccggaaguuagcaguggcagaaaagccgaucgccaacaucgagaccggggagauucuuugggacaagacagcggacaucaaguacuucgagaaacuguacaauuacaaacgacugcucgugacgcacgagguccgggagaacuauggcgcuauguucaaacagacucuguuuaaggcuucuuacaacaagagcaagacacuggugcccaagaaaaaccacauggagaccagugucuauggaggcuacagcaaucaggagacggcauaucucgcaauuguccgcauacccuucaaguccggguucaaguucauugugguggguauccccacccggauggucgcgaagaucaagcacuaucagagccugggggccacgcugaaccaggccacccacaagguuaucgagccgaaguucacgaagaucagccgcaagaccaaacagaccgugaucagcgacuacgaagucgugcuccccaagguguaccucgaccaaguuguccgugaccaggugaagggccagauguaccgcuucagccugggcagugacaaggaguaccacaauguccaggagcucuaccugccacugucuauccagcaggccuucguuggacauuacgacgaauccgaugaccagcggagcaacgacuuagugaaggucuacgacgcagcgcugaagcagcugcagcgauauuucccccuacacuuaucccggaacuucgaucaaguggccagccaggcccaccagaguuuugagggucugaagaacaauguccaaacaagcgacaagcagcuaggcaagaaggaagugcugaacucacuauucgucggucuccacgcgaacgcgacgcgcagcaaccugucgguccuggggaugagcaaggacuucggccggauuaaguccaacggcaucacccuaaccgaccaggccgagaucaucuaucaaagccccacggggcuguucgagcgcaagguugcccugaaggaccucuga

SEQ ID NO: 7707 - RNA, 4086 nt, Artificial Sequence; identical to SEQ ID NO: 1907
  Cas9 variant

SEQ ID NO: 7708 - RNA, 4089 nt, Artificial Sequence; identical to SEQ ID NO: 1908
  Cas9 variant

SEQ ID NO: 7709 - RNA, 4089 nt, Artificial Sequence
  Cas9 variant
augaacgaaccguacggcgucggucuagacauaggaaccaacuccgucggcuggaccgucguggacaugaacggacguguacgcaaagucaaagggaaaaccgcccucggagcacgccucuucaaagaaggggccaccgcagaagaccgacguggcuuucgaacgacgagaaggcgccuaaagcguguaaaauggcguuuaagacuacuccgggaguucuucgaccaacccaucuccaaaauugaccccaacuucuucgcccgaagaaaauacagugacaucagcccacgugaccccaauuauaacggacuagcaaaaacccuguucaacgacaggacagacaaggaguucuacgacgacuacgccacgauauaccaccuccgcgacaaacuuaugacauccaaucgcaaguucgacauacgagaaaucuaccuagccauccaccacauaguaaaguaccgcggaaacuuccugcgcacgggucccgcaucccaauacggaagugccucgcugcaccuggcaacuuccuuccaaaagcuaaaugacuuauucgcccaauccgaggaaacccuaaaccuaaagcucgugacggacgaagcucugcugcagcaaauacaacagauccuaguccgcacagaucugucacgauccgaacaacagcgacaaaucuggccacucauggcaguucuaacuggagcgucggcagcagagaaaaagcgccagaaaaacguuguaguagaauuaagcaaagcccuagucgggcucaaagcaaagaugaacgucgucacguuaaccgaagucgacgccgcaguaguaaaagacuggaccuucaccauggaggaaagccaagacaaacugcccgagaucgaagaacaacucagcgaggucggccaacaaauaauggaugaagucauacaacuuuacgccuccgugaaccucgcgcaacuaauccccgcgggaaaacgcuucucgcaacacauggucgaaaaguauaaacaccacgaaaagaacuuggaacugcuaaaaaccuauauacauucacaaagcgacagcaaacgaggccgcgaaauccgagccacguacgaccgguacauagacggcguggacagcaaacccgucacacaggaaauguucuacaaagaccucaugaaauacguagaggccgacgcaaccucaaaccaucuagccgcggaaauaaaggacgaaaucgacagcgagcaguucaugccaaaacucagaacuaagcagaacggguccauccccuaucaggugcaacaauacgaacucgaccagauaaucucccaccaaaagaaauacuaccccuggcuaggcgaagaaaaccccgucgccgaacgcagaggaaaauucccauauaaacucgacgaacuggugggcuuccgcgucccauacuacguaggaccgcuaauaacaaaagaagaccaacaggcaaccucaggcgccggguucgcuuggaugguccggaaggccgacggacccauaacgccauggaauuuugaucaaaaaguagauagaaucgcgagcgcaacagccuucauacaaagaaugcaaaccacagacacauaccuaaucggagaagacguacucccugcccgcucacucaucuaccagcgcuucaugguacucaacgaacuaaacaacaugcgagucgaagauaggaaacuagcuccacaacaaaaacaacgccuauacaaccaggucuuuaaacaacaccagcacguaagcgucaagaacauccaacaaaaucuaauggaugccggggaauaccgagaagccccgaaaaucacaggccuagcggacccgaaaggauuuaacucgucacugucgaccuaccacgacuucaagaagauccuacccgaggccaucgccgacgaacacaaacgagcggacauagaaaagaucauccuauggagcaccacauucgaagauuccgcaaucuucaaacaaaaacucgaagaagucgccuggcugaccgaugcucagcgaaaacaacuaucuggccuccgguaucgaggauggggccaacugucacacaagcuccucauagccuucaaagacgacaauggccgaagcauaauggacggacuaugggaaacaagcgacaacuucaugcaacuacgcaaacagccggcaaucgagacccagauaaaggaggcuaaccaggcuaaccucacggacgccgacauacaagacacaauaaacgaacuuuacacgagcccucagaacaagaaagcaauacgugaaguaaugcucgucuuagacgauaucaaaaacgcgaugcacggacaaacccccuccuggauauuuguggaagcagcucgcggaggcggaguggcgggccgccgaacccagucacgcuccagccaaaucgucgaagccuacaagggaaccgcgaaagagauagucucugaaaaaguacaacaugaauuaaacgagaaaauaaaagcaaaggcagacuuuaacacgcgacugguccuguacuuucuccaaaacggacgcgaccuguacaccaacgaggccaucaacaucgaccggcuuagcgaauaugacaucgaccacauccuaccacagucucuagucaaggacgacucccuagacaaccggguacugacaucugcacgaaucaaccgagagaaaaacgacaccuucgccucagaaaaauucggccggaagaugggcgcccaauggcgugagcuacacagaaacggguuaaugacacagcgcaaacucaaacaccuacucaugaggcccgacgaaaucuccaaacacgccacagacuucauuaaccgacaacucgucgaaacgagacaagucauaaaacucgucgaagaacuaauauccuccgaauacccagccgcauccaucguggcaguaaaagcgaaccucacccaccaauucagacaaacguucaacuucccgaaacuucgagagguuaacgacuaucaccacgcguucgacgccucccuaacagcauucaucggcauguaccugcugaaacaguacccuaaacucgaacgcuucuucgucuauggcaaauucgccaagcagccaaucaaccucacccgguucaacauaauucgcaagcucgccguagcagaaaaaccaaucgcaaacaucgagacaggagagauucucugggacaagacggccgacaucaaguacuuugaaaaacuuuacaacuacaagcggcuccuugugacccacgaagucagagaaaacuacggcgcaauguucaaacaaaccuuauucaaggcgagcgacaacaaaucaaaaacucuagucccaaagaaaaaccauauggaaaccuccguauacggcggcuacagcaaccaggagaccgcguaccucgccauagugcgcauaccauucaaaucagguuucaaauucaucguagugggcauacccacacgaaugguggcaaaaauaaaacacuaccaaucucucggggcaacccuaaaacaagccacacacaaagucaucgagcccaaauucaccaaaaucagccguaaaacgaagcaaacagucauaucagacuacgaagucguguuacccaaaguauaucuggaccaaguugugcgugaccaagugaaaggacagauguaccgauuuucacucggcucugacaaagaauaccauaacguacaagaacucuaccucccccucagcauccaacaagccuucguaggccacuacgacgaaucagaugaccagcggucaaacgaccugguaaaaguuuacgacgccgcucugaaacaacuccaaagauacuucccgcuacaccugagccgaaacuucgaccagguugccaaccaagcacaccaauccuuugaaggccugaaaaacaacguucagaaaagugacaaacaacuaggaaagaaagaaguccucaacucccuuuucgucggacuccacgccaccgcgacaagguccaaccuauccguccuuggaauguccaaagacuucggccgacuucaaagccggagcgguauaacacuaaccgaccaagccgaaauaauauaccaaucacccaccgggcuauucgaacgcaaaguagcucucaaggaccucuga

SEQ ID NO: 7710 - RNA, 4089 nt, Artificial Sequence
  Cas9 variant
augacuaaacuugggaaaccauacggcaucggcgucgacauugguagcaacuccaucggguucgccgccgucgacgaaaacagccaccucauacgccuuaagggcaaaacuguaauaggcgccagacuguucgaagagggcaaagcggcugccaagaggcgggcaggcaggacaacccggcgcagacucucccgcaaccgauggcgccucagcuuccucagagacuucuucgaaucacacauaaccccaacagaccccaacuucuucaugcgacaaaaauacucugaaauaagccccaaagacaaggcgcgguacaaauacgagaaaaggcuauucaacgaccgcacagacgccgaguucuaccagcaauacucgacgauguaccaccuuaggaaccgccucaugaccgaccccagcagagcggacguccgcgaaauauacuucgcaauacaccauauucucaaaagccgcggacacuuccugacacccggggacgcuaaagacuucaauacuaacgaugucgcccucgacgaaaucuucccagcccuucaggaugcauacgcccaggucuacccugaccuaggcauaacauucgacgaggacaaggccaaugaguucaaaaccauccuccucaacgaaaucgcaaccuccaucgauacgcagcgggcccuagugaaacuccuccuagccgaagaagacgacaaggacauccucaaacagcaaaaacaaguccugaccgaguucgcaaaggccguggucggccucaaaacuaaacuuaaccuagcgcucggaacggaaguagacagcagcgaagcaacagccuggaacuucucacuuggucagcucgacgacaagugggcgggcauagaaagcgcuaugaccgacgaaggcaccgaaauccucgaccaaauccgugaccuuuauagagcuaggcuccucaacggcauaguccccaccggcaaaacgcuaucgcaagccaagguagacgacuacacacaacaccaugaagaucugcaacucuucaaagcauaccucaaacaacucgaagacgacgggaccgccaaagcgauccgccaacuauaugaccgauacauagacggcgacgacgcggcccccuuuuuacgugaaaacuucgucaaagcccuaacaaaagacguaacugcccaccccaauaccaaaagccccgaacuucuagaacgacuagcacagcccgacuucauguuaaagcagcgcaauaaggccaacggggccauucccguucaaaugcagcagcgggaacuagaucaaauuauuaagaaucaagcgguauacuacgacuggcuagccgccccaaaccccguagaaaaacauagaaaaucaaugcccuaccaacucgacgagcuccuaaacuuucgcauccccuacuacgugggaccccuggucaccgcaaaggaacaaaaagcagcccagggaggagucuucgcauggaugguucgaaaagacccggaaggaaacaucacucccuacaacuucgacgaaaaagucgaccgagaagccuccgccaacaccuucauacaacgaaugaaaacuaccgacacauaccugauaggugaagacguacuccccaaacagucucuucuauaccagagguacgaaguccuaaacgagcucaacaaugugcggguaaauaacgaaaaacuaagcauugaacagaagcagcagguaauccgcgagcuguucgagcggcauaauucggucaccauuaaacaauucgccgaaaaccuccgggcccacggagacuacgcucacauaccagaaauaagaggacucgcagaugaaaagcgauuccugagcucgcucuccaccuaccgccaacuaaaaucccuacuacccgaggcgauagacgacccugcaaagcaagcagacaucgagaacauuauagcauggucaacaguuuucgaagacgccgccauuuucaaaaccaaacuuaaagaaauauccuggcucggcuccgaggccaucacaaagcuaagcaacauccgguacaggggcugggggcaauucucccgcaaauuccucaacggucucacacugggcaacgggcacaccaucauacaagaauuacuacucucaaccaacaaccuaaugcaaauauuaaccgacgaaacccuccaaaagaaaaugaccgaacugaacgccgauaaacucaaaacggcuaacaucaacgacgccauugacaaugccuacaccuccccaagcaacaagaaagcacuaagacaaguacuacgcgucgucgacgacaucaaacgcgccgccgauggccaagauccaagcuggcuauacguagaaacggccgacggaggcggaacccccgguaaaagaacccgcgcccgccaacaccaauuacaagaaauauacgcaaacgccgcccacgaacuaaucgauaccgcaguccguggcgagcuagaagacaagauuuccgauaaagccgacuuuaacgacagacucguccuauacuuuaugcagggcggacgagacaucuacacgggagccccgcucaauauagaccaacuuagcuccuacgacaucgaccacauccuuccccaaucacucauaaaagauaauucacucgacaacagggugcucguccacgcgaucauuaaccgcgagaaaaacgccacauucgcguccacaauuuacgcacagaaaaugaacgcaaccuggagacaauggcacgaagcaggacucaucagcggccgcaagcuaagaaaccuccaaaugcgaccugaccaaaucgacaaauacgcaagcggcuucguagcccgacaauuaguagaaacacgccaaauuauaaaacuuaccgagcaaauaguggccgcccaauacccagacacgaagauaauagccguaaaagccggccucucccaucaacuccgcgaagaacucgaauuuccgaaaaaucgugaugucaaccacuaccaccacgccuucgaugccuuccuugcagcacgaauagguacauacuuacucaaacgauucccaaauuugcaagcauucuucacauacggaaaauucacaaaagccgacgucaaaaaguuacgaggcuuuaacuucauccgcgacauaacucaugcugaagacaaaauaguagccaaagacaccggcgaagugguaugggacaaacagcgggauguagacgaacuugacagaauauacaauuucaaacguaugcuaaucacccacgaaguaagauucgagaccgcagaccucuucaaacagacuguauacggcgcccgagacuccaaagaggcaggcggcuccaaacaacucaucccaaagaagaaaggcuacccagucgacauauacggcggcuacuuuagggaaaacacugccuaccucgccgucguuaaagucacaaagaaaacugaaacaaucuucaaaguggucaaaauagccaccagccagguagcagcacuaaacaaagccagaucaagguccaccgccgaagaacucucuguucucacggaguuacuaaaaccaaaauucucaaaagucggcaaaaauggaaagauaacagacacccccuucgagguaguacugccgcgagucccucgagaacaacuguucuacaacgccaaguacgguuucuucauggucaacuccgacacaauguuccacaacuuccaagaaauauggguaucucgcagcgaucagaaaauucuccaacaaauuaggaaagcgaagaucgacuacccgaacguugaccaagaccuagacaaucuuuuccacaaccucgccgaccaaaucgucaaguacuucgaucuuuacucaauagccggcuucaaggagaaaaucucccaaagccaaaacacauucaacgaccucgccguagacgacaccgaucaaucagucgguaagauuacagucauaaacgaacuccuuaagggggcccaagccaacggcaugacaggcucccuaaagguccuaaaaauaaguacgccauucggauucacacaagacaagagcggcguacuaacuaaagacagcuccauaauauaucaauccccuaccggccucuucgaaagaucgguacgacucaccgaccucuga

SEQ ID NO: 7711 - RNA, 4089 nt, Artificial Sequence
  Cas9 variant
augaccaagcuggggaaacccuacgggaucggcguggacaucgggucaaacuccaucggcuuugccgccgucgacgagaacagccaccucauccgccugaaggggaagaccguaaucggcgcgcgacuguuugaggagggcaaggccgccgccaagcgccgcgccgggcgcacgacccgccgacggcucucccgcaaccguuggcgacugucauuccugcgggacuucuucgagucccacauaaccccuaccgacccuaacuucuucaugcgccagaaguauagugagaucucccccaaggacaaggcucgguacaaguacgagaaacgccucuucaacgacagaacggacgccgaguucuaccagcaguacaguaccauguaccaucuccgaaaccggcuuaugacagaccccucccgggccgacgugcgggagaucuacuucgccauccaccacaucuuaaaaagccgcggccauuuucugacgccgggggacgcaaaggacuucaacaccaacgaugucgcacuugacgagaucuuccccgccuuacaggacgcuuacgcucagguguacccagaucugggcauuaccuucgacgaggacaaggagaacgaguucaagaccauccugcucaacgaaauagcgaccuccaucgacacgcagcgggcucuggugaagcugcuccuggcggaggaggacgacaaagacauccugaagcagcaaaagcaggucuuaaccgaguuugccaaggccgugguggggcugaagaccaagcucaaccucgcgcugggcacagaaguugacagcuccgaagccacggcguggaacuucucacugggacagcucgacgacaagugggcagggaucgagucggccaugacagacgaaggcaccgagauccuggaccaaauucgcgaccuguaucgagcgaggcugcugaacgggaucgugcccaccgguaagacccugucccaggcgaagguggacgacuacacccagcaucaugaggaccuccaacuguucaaggccuaucugaagcagcucgaggacgacggcaccgccaaagccauccgccaacuguacgacagguacaucgacggggacgaugcagcaccguuccuccgcgagaacuuugucaaggcacucaccaaggacgugacggcccacccaaacaccaagucacccgagcugcuggagcggcucgcgcagcccgacuucaugcugaagcagagaaacaaggcuaacggcgccauaccggugcagaugcagcagcgagagcuggaccaaauuaucaagaaccaggcuguauacuaugacuggcucgccgcgccuaaccccguggaaaagcaccgcaagagcaugcccuaccagcuugacgagcugcucaacuuccgaaucccguacuacguggggccccugguuaccgccaaggaacagaaggccgcucaagggggaguauuugccuggauggugcgcaaggacccagagggcaacaucacccccuacaauuucgaugagaaagucgacagagaggccucugccaacacguucauccagcgcaugaagaccacggauaccuaccugaucggcgaggacgugcuaccgaagcagucacuccuguaccagcgauacgaggugcugaacgaacucaacaacguacgcgugaacaacgagaagcugagcaucgagcagaaacaacaggucauccgugagcuguucgagcgccacaacuccgugacgaucaagcaguucgccgaaaaccuccgggcacacggggacuaugcccacauccccgagauccgcggccuggcagacgagaagcgguucuugagcucccuaucuaccuaccgccagcugaaaucgcugcuccccgaggcaaucgaugaccccgccaagcaggccgacaucgagaacauuaucgcguggagcaccguguucgaggacgcagccaucuucaagacuaagcugaaggagaucuccuggcuugggagcgaagccaucacgaaacuuuccaacauccgcuaccggggcugggggcaguucagccgcaaguuccugaacggcuugacccucggcaacggacacaccaucauccaggagcugcuucucuccaccaacaaccugaugcagauccugacugaugagacgcuccagaagaagaugaccgagcuaaacgccgacaaguugaagaccgcgaacaucaacgacgccauugacaacgcguauaccagcccguccaacaagaaggcccuacgccagguccugcgcgugguagacgacauaaagcgggccgcggacggccaggacccgagcuggcuauacgucgagacggcugacggaggcgggacccccggcaagagaacccgggcccgccaacaucaacuccaggagaucuacgccaacgccgcgcacgagcugauagacaccgcagugcggggcgagcuggaagacaagaucuccgacaaggcagacuucaacgacagacucgugcuguacuucaugcaaggagggcgggacaucuacaccggggcgccccugaacaucgaccaguugucuuccuacgacauagaccacauccugccccagagccuaaucaaggacaacucucucgacaaccgcguacuugugcacgcaauuaucaaccgggagaaaaacgccaccuucgccagcaccauauacgcccagaagaugaacgcuaccuggaggcaguggcacgaagcaggacucauaagcggccggaagcuccgcaaucugcagaugcggcccgaccagauugacaaguacgccuccggguucguggcucgccaacuggucgagacgcggcaaaucauaaagcucaccgaacagaucguggccgcccaauaucccgauaccaagaucaucgcgguaaaggccggccugagccaccagcugcgagaggagcucgaguucccgaaaaaccgggacgucaaucacuaccaccacgccuucgacgccuuccuggccgcgcgcaucgggaccuaucugcucaagcgcuuccccaaccugcaggcauucuucacguauggcaaguucaccaaggccgaugucaagaagcugcggggguucaacuucauccgcgacaucacccacgccgaggauaaaaucguggcaaaggacacgggugaggucguuugggacaagcagcgggauguggacgagcucgaccgcaucuauaauuucaagcggaugcugauuacgcaugagguucgcuucgagaccgcggaccuguucaaacagaccguguacggcgcccgggauuccaaggaggccgggggcagcaagcaguugauccccaagaagaagggauaucccguggacauuuacggcggguauuuccgcgagaacacagccuaccuggcggucgugaaagugacgaagaagacugagaccaucuucaaagucgugaagaucgcgaccucucagguagccgcucugaauaaggcccggagccgcuccacggcggaggagcucagcguccugacugaacugcucaaaccgaaauucuccaaggugggcaagaacggcaagauuaccgacacgcccuucgagguggugcugccccgcgugccccgcgagcagcuguuuuacaacgcuaaguacggguucuucauggugaacucugauacgauguuccacaacuuccaggagaucugggucucccggagcgaccaaaagauacuccagcagauacggaaggcuaagaucgacuaccccaacguggaccaagaccuggacaaccuguuccacaaccucgccgaccagauagugaaguacuucgaccucuacuccaucgccggcuucaaggagaagaucagccagucccagaacacguucaacgaccuggcggucgacgacacagaccagagcguggggaagaucaccgugauuaacgagcucuugaagggcgcccaggccaacgggaugacgggaucccucaagguccucaagaucagcacaccguucggcuucacccaggacaagagcggggugcugacaaaggacuccagcauuaucuaucaaagucccaccggccuguucgagcggagcgugcgucucacagaccuguga

SEQ ID NO: 7712 - RNA, 4089 nt, Artificial Sequence
  Cas9 variant
augaccaagcugggcaagcccuacgggaucggcguggacaucgggagcaacucuaucggcuucgcagccgucgacgagaacagccaccucauccgacugaaggggaagaccgugaucggcgcucggcuguucgaagagggcaaggccgccgccgaccgccgggccucccgcacgacaagacgcaggcucagcaggaaccgguggcgccuguccuuccugcgggacuucuucgagucgcacaucaccccgaccgaccccaauuucuucaugcgacagaaguauucagagaucagccccaaggacaagucccgcuauaaguacgagaagcgccuauuuaacgaccggacggacgcggaguucuacaaguaugagaacugcccaaccauguaccaccuacgcaaccggcugaugacagacccgagcaaggcugacgugcgcgagauauacuucgccauacaccacauccucaagucccgggggcacuuccugacccccggcgaugccaaggacuucaacacgaauaaaguagcggugaacaagaucuuccccgcacugcaggaugccuacgcccagguguaccccgaccuagacaucaccuucgacgagaacaagguuaaugaguucaagacuguccugcugaacgagaaggccaccccgagcgacacgcaacgcgcgcuagucaaccuccuccucgccaaggagggggaccgcgacauccugaagcagcagaagcaggcccugaccgaguucgccaaggccgucgugggccucaaaaccaagcugaacguggcacuggggaccgaggucgacuccagcgaggccacggccuggaauuucucccucggccagcuggacgacaaguggaccggcauugagagcgccaugaccgacgaagggaccgaaauccuggaccagauccgcgaccuauaccgcgcccggcugcugaacgggaucgugcccgcggggaagacgcucucccaagcgaagguggacgacuaugcacagcaccacgaggaucuggagcuguucaaggacuaccucaagcagcuggaggacgacggcaccgccaaagccauccgccagcuguacgaccgguacaucgacggcgacgacgcgaagcccuuuguccgcgaagacuucgugaaagcccucaccaaagaggucaccgcacaccccaacgccaagagcccggagcugcuggagcggcucgcucagcccgacuucaugcugaaacagcgcaacaaggcuaacggggccaucccuguccaaaugcaacaacgggagcuggaccagauaaucaagaaccagucagucuacuacgacuggcucgccgccccaaacccgguggagaagcaccgcaagagcaugcccuaccagcuggacgagcugcucaauuuccggauccccuauuacgucggaccccugguaacggcaaaggagcagaaggccgcccagggcgggguauucgccuggaugguccgcaaggacccggaugggaacauaacccccuacaacuucgacgagaagguggaucgggaggccagcgcgaacacguucauccagcgcaugaagaccacggacaccuaccugaucggcgaggacgucuuaccgaaacagucccugcuguaccagucguaugaggugcugaaugaacucaacaacgugcgggugaaugacaacaaguuguccuucgaccagaagcagcagguccugggggaacucuucgagcgccacaacacggugaccaucaagcaguuuguggauaaccuguuagcccacggggacuacgaccggaucccagaggugcgcggccuugccgacgaaaagcgguuccugagcucccugagcacguacaaccagcucaaggggauacugcaugaagccaucgacgacagcgacaagcagaccgacauagagaacaucauugccuggucuaccauauucgaagacaaagcgaucuucaagacgaaauuaaacgagaucucuuggcucaacgccggcaugaucaacagccuggccaacauccgcuacagaggguggggacaguucagucacaagcugcuaaacgagcugacgcugucuaccggccgcaccgucuuugaggaacuccugauuaguagccacaaccugaugcagauccucaccgacgaaguccugaagcagaagaucgccgagcugaacgcgcaugagcucaaggccuccgguaucuacgccgccauugacgacgccuacaccucuccuuccaacaaaaaggcgcugcgccagguccugagcgugaucgacgacaucacgaacgcugccggccaagcgccuaauuggcucuacaucgagaccgcggacggggacggcguccccgggaagcgcaccaacucccgccagcggaagauucaggagaucuacgcgaacgccgcccaggagcugaucaccggcagcgugcgcggcgagcuggaggacaagaucgccucgcgggccgacuuuacggaccgccucgugcuguacuuuaugcaaggagggagggacaucuacaccggcaaaccccuuaacaucgacaaccuuuccagcuacgacaucgaccacauccugccgcagucccuaauuaaggacaacagccucgacaaucgcgugcugguccacccgcuggugaaccgggagaaggacaccaucuucgcgucuacucgcuucgccaagcagaugaacggcauguggcggcaguggcacgccgccggccucaucagcucccgcaagcugcgaaaccuccagaugcgccccgacgagaucgacaaguacgcgagcggguucgucgcccgacaguuaguggagacgcgacagaucauuaaacugacagagcagauaguggccgaccaauacccggacaccaaaauuaucgccgucaaggccggcuuaucuagccagcugcggaaggagcuggacuuccccaagaaccgagaggugaaccacuaccaccaugcguuugaugcauuccuggccgccagaaucgggaccuaccuccugaagcgcuaccccaacuuagagcccuucuucacguacggcaaguucaagaagacagaggugaagaagcucaaguccuucaacuuuauccgggauaugacccacgccaaggacaaaaucguagcgaaggagaccggggagauaguuugggacaacgccagcgacaucaacgagcuggaccgcaucuauaacuucaagcgcaugcugaucacgcacgaagugcgguucgagaccgccucccucuucaagcagacccuuuacgccgccaagaauagcaagaaccgcggaggcucccggcagcugauccccaagaaaaagggguaccuggucgacaucuacggcggguacacacaagagacgggaagcuaccuguccguggugcgccuaacaaagaaggcgauguacgcagucguaaagguuagcacccgagacgccgccaagcucgccguugccaagagcaucuccgagcagaaggagaacgaaacccugaagaaaaucaucgacgggaaacugagcaagacguccaagaagggcaagaccacccaccagcuguuugagaucguccucccccgcgugggccagaagacccuguucaagaacuccaaguacaaccaguuccucgucaacuccgacacguacaugcacaacuaccaggagcuguggaugccccgggaguaucagcgcauguggaaggacauccugcucagcaaccacggggacgcgcagcuggagggccagcuggaccaaaucuucaaauuuaucgugucccaggugaacagcuacuucaaccucuacgacaucaaccaguuccggaagaagaucgccgacgccaccgacaaguucgcgaagcugcccacgcacgacacugacaacgcgcgcgggaagaucgccacgaucggccagcugcucaucggucugcaggccaacgccaugcgguccgacuugcgcaaccucgauaucaagacuccguucggucugcugcaaauuggcaccgggaucacccucgaccuggacacaagcaucaucuaccaaucccccaccggccuguucgagagggaggucccccucaccgaccuguga

SEQ ID NO: 7713 - RNA, 4089 nt, Artificial Sequence
  Cas9 variant
augaaccaggaacccuacgccaucggucuugauauaggaaccuccagccucgggugggccaacgcugacauggacggcuacaucgcacgcgucaagggacagaccggccucggcguccgcuuguucgaggaaggccagcccgcugcggaccgucgaucauuccgaacaaccagaagacgacuuucgcguaggcgcuggcgccuccgccuacuacgagaaaucuucgacgagcccaucagcagcaucgacccuaacuucuucgcacgccagaaggcuucauccaucagcccaaaagacgaucgauucgaaaccaccuaccaacucuucaacgacaaaacggaccaagaguucuacagcaaauacccgacaauauaccaccuccgcugggcacucaugaccgaacaccgcaaguuugaccucagagaaauauaucuagccgugcaucacaucguaaaauacagaggaaacuuccugcgauccggcaaccccaagagcuucaaaccgucagaacuagacuuuucacaaagguucaaagaagugaacggacucuggcaccuaauauucgacgaaguagcaccccaacugccgaccgauaaccuagaagaaauaacaaaacucguacuggacaccacgcgaaccagagcagaccggcagcgcgaaagcgucaaacuccuaauggccgccaccgacaaccauaaagacuggaagccauaccuaacagaauuuaccaaagcaauacugggcuuaaaaacuaaacuuuaccuacuaaccggcgucgacgucgcuaaggcagaucagaaaacuuggacauucucacucgaagauauagaggaccaccgugcagaucucgagaccgccuucgacgaucgcucccucgagcuaaucgagaaacucguagaccuccaagccgccauucaacuaacggagauaaugccgucaggucaauacuuuagccaaagcaugaucuaccgguacgaccaacacaaggaacaccuuagguggcuaaaagauuacgccgaacagcagaccgacgccaauaaacgcaaagccgugcggcucgccuacgaccacuacaucgagggggacgccaaaggcaaaccagagauagccgaugacuucuacaaagaacucaaccgcauacugaagggcgacaccagcgaacuagccaagaaaaucaaccacgaaauagcacucgagcacuucaugccaaaacaacgaacuaaagaaaacggagucauuccauaccaaauucaucaacaagagcuggacucaauuauagacaaccaaaagaaauacuaccaguuucuuggcgaagacaauccaguggucucgcaccauggaucccaacccuauaaaaucgacgagcucgucuccuuccgcguaccuuacuacgugggcccgaugauaacagcagaccaacaaaagaaaaccgccgcaggccaauucgccuggaugguucggaaagauuccggagacaucacccccuggaacuucgacgauaaaguagaccgcaccgcuuccgcaacaaacuucauacagcgaaugaaaaccaccgacaccuaccuaaucggagaagauguacucccacuccagucccuuaccuaccagaaauucauggugcucaacgaacucaacaacauccgcaucaacggcgaacuccucacaagagagcagaaacaacgcacauauaacgacguauucaaaggccacggaaccgucaacgucaaaucauugauaaaaagucucgagugccacucagaaguuaccggagcgauuaaagucgagggucuagcggacccgaaacgcuuuaacuccgcccuaaccaccuaccgcgacuucaagaaaauacugcccgucgcaaucgaccagccgcagcgccaagcggacauagaacgaaucaucaacuggagcacaauauucgaagacgcagacauuuuuaaagccaaauuacaagaaauagacuggcugacagacacacaaagagacaggcuaagcaccaaacgauaccgcggcuggggucgacuaagcgcaaaacuucuccuaaauauaaaggacacacaaggucucucgaucauggaccaacuauggaacacccagcacaauuucaugcagauaguacacgaaccagauuacgcugagaaaaucgagaaaaccaacgccaagggacucaagcaacaagauauuuucgaaacuaucaaugaaauguacaccagcccacaaaacaagaaagcgcuaagacaaauacucgcagucguaagagacauccagaaagcccaucacggacaagccccgucccgcaucuucaucgaagcagcacgcggagccgaacaaaauccccaaaggacccgacaacgccagaaacaacucgcagaccucuucgccgaccaggccaaagaaaucgugaaugaaaccguagcucaggaacuuaacgacgaaacagauaacaaagcaagguuuaccgaccgccuuaugcuauacuuccuccaaaacggccaagacauguacacaggcgaaaaacuaaacaucgacaagcuaagcaccuacgauauugaccacauccugccacaaucguuagucaaagaugacagccucgacaacagaguccucgugagcaaaguagaaaaccucaagaaaaacgaucacuucgccagcgaacucuacgccaggaaaaugcagggcacuugggaauuauggcgaucagcaggccuuauuuccgccagaaagcucaagcaccuacucaugcgacccgaugaaaucaauaaauacgcaaccggcuucauccgccggcagcucgucgagacccgacaaguaauuaagcuagucacugacguccucagcaacgaguacgauagcgacaaaacaaaaauuaucagcgucaaagcagggcucagccaccaguuacgcauggaacucgaccucccaaaaguuagggagcuuaacgacuaccaucacgcauucgacgcuuuccuggcagucagaaucggaaccuaccuccuaaaaagauacccgaaauuagagcgguucuucguauauggccaauaucaaguagcaccucaacuggaccucaggcgcuucaacuucauccacgaccuaguguccggcaaacaggagaaaauaguggcugaagaaaccggcgaaauugucuggaaccgcgaaaaggacguaucauacaugaagcaucuacucagccugaagcaucucuuaguuacgcacgaagucaaagaagaucacggagcacuuuucaaccaaaccaucuacaaggccaagaaagacaacggcaacguaggaggcaaaaugaagcuauuacccacgaaaucuaacagacccaccgaaaucuacggcggccauucaucgcaagcgauagcauaccucgccaucguaagaguaaauggcaaagaaccgucauaucgaguaaugggaguuccuauucggauacucgaccaacucaagcaagcgaagaaacagggggaauaugccgaacgccucgcccucaaacaauucuucacaccagacuucacaaaaggaaaaggaaaaaucguuucugauuucgacguagucaucccccacauaccccuccuccagccuguaauugaugaaauaagcggccaaucacaccgcuucgcccucggaacaaacacauacuaccgaaaccuccagcaacuaauacuuacccuggcggaccagaaaguccuaaucagcaaggaaacgggcguggacgaagagaaaaagcucguagaaguguacagccacauaugccaacagguaaugaaauucuucccgcuguacgaucgaaacaaauuccgcgaacuccuaguagacucacgaucacacuuugagcaacuaccaaucguaaacagauacuccgacgccggcaaacucgagauugcuggcaaacgagggauccuccagcagauaaugguaggacuacacgccaaugccacacccggcgauuuaaaagaacucggcguuaaaacccccuucggcaaacugcaaguaccgggcggaaucaaacuuacagaaaacgcaaaacucaucuacgaaucgccgaccggccuauucaaaagagaaguaaagauuaccaccgaguga

SEQ ID NO: 7714 - RNA, 4089 nt, Artificial Sequence
  Cas9 variant
augaagaagaaggccgagaagaucuaccugggccucaacguggggaccaacagcaucggcuacgccguuaccgacgagcaguaucgccugcugaaguucaaugggaacgacgcguggggcucaauaguauucgacgccgcgagcuccaacgaggaccggcgcaaccaccggcucgcccgcagaaaccuggaccgccggcagcagcgcaucguguggcugcaggagaucuuugcaaaggagaucagcaagguagacgaccgguucuucauccgccucuccgagagcuucagguggcgcgaggacgugcaggaucgguauguguucuucaacgacaaggaguacacggacguccaguacaugaaggaguaccccaccauccaccaccugaucugcgagcugauggacaauaagaccccgcacgacgugcgccucguauaccuggcgugcgccugguugaucacccaccgggggcauuucuuaaacaaccuaaacgucgaaaagcuggaugagaucauggacuucuccagcguguaccagaacuucaucaacuauuucacagagaauggcuacaagagacccuggggcgagaucgacguguccgcucucagcgagguccugaaacagaagaccgggaucaccgugaagaacaaggagcugcagaacaucuuacuggagggcaagaagcccgagaaguccggaaccgaggaguuucccuucagccaggacuccaucauccggcugcucgccggcgggcaaugcaagcugaaagacguguucuguaaggaggaguaucuggaccucgguagcgucucccugggaauggaugaggagaaguucgacgagaucagcggguccaucggcgaggauuaugaccugcucaucgcgcugcgcgggcuguacgauuggagcgugcucgccaaccuucugaacggccacuccgagacuaucagcauggccaaggugcagauguacgagcagcacggcaaggaccuccagauccugaaguacuuuguacggaaguaugugccggacaaguacaacgagguguuccgcaaggccaaggccgacaauuaugucgcguacaccgggcacauggacaaggacaccgccagccaaaucaagaagaaggccaaggccgaggaguucuccaaguacguccugaagcucaugagccccaucaaacccgagaagaccgaccugcaguccuacgaggacaugugcgagcggcucaagcucaaucgcuuccugcccaagcagaagaacacggacaacagggugaucccccaucagcuguacgaguacgagcucauccagauccucaagaacgccagcguauaccugcccuuccucaacgacaccaacaacggcauuuccgaggcggacaaggugcugagcgucuuccgguacaagauccccuacuacguggggccccugaacgaggaguccagcuucgccuggaucucccgcaagcaaggcaagaucacucccuggaacuucaaggagaugguggacgaggacgccagcgagaacgccuucauucgucgcaugaccaauaagugcacguaccuccccaccgaggacguccugcccaaggacucccugugcuaucagaaguucauggugcugaacgagaucaauaaccuccagaucgacgggcugaagauccccgugaaggccaagcagggcaucuaccacgagcuguucgagaagaacaagaaagucaaacggaaggacaucgaggaguaccucauccgcaacaacuaccuggacaaggacagcaccgaacugaucucaggcaucgacgagcagauccacagcgggcucuccagcuacugcgcguucuucaaccugcugaacaagaaaauccucuccgaggacgacguggagcggaucaucgaacgcgccucguacgccgaagacaagucccgggugaucaaguggcugcgcaaggaguacccggggcugagcgaagacgacauccgguacaucgcccgcaucaagauccgggacuucggccgccucagcaagaccuuccugacggggcugaaggggugcgacguguccaagggcuucgacggacaggacguggagaugaucagcauccuccagaccaugugggagaccaacgacaauuuaauggagauccuguccgacaaguacaccuucuuggaagcccuggaggcguucacgcaggaguacuacaccgggaaaaagaagucccugaaggagcggcucgacgagaugcgcgugucaaacagcgucaggcgccccguguaccggacccuggcgguugucaaggacaucgagaaggccuucggcaagcccaacaagaucuucguggagaugacccgcgggggccaagccgaccagaaggggaagcgcaucaagucccguaaacagcagauccuggaccuuuacgacaagugcaaggacgacgugcacgaccugauguggcagcuggagagccucggcgaauaugcggacucccgccugcagagcgaccggcuguaccucuacuucaugcaguucggcaagugcgccuacuccggcgcucacaucggcuucgagcagcugauggccgggagcgucgaguaugauaucgaccacaucuacccgcaguccuacgugaaggacgacagccugaacaacaaggugcucgucuuauccgaccugaacggcacgaaggacaacauuuaccccgugagccccgagauccgcggcaagaugcaggggcucuggucaugguggaaccacgugggagccaucagcgacgagaaguacaagcggcugauccgcagcgcgcccuucacagacgaggagaaaaugggguucaucaaccggcaguugaccgagaccucccaguccacgaaguucaucgccgaccuccugaaggagcgcuuucccgacgccgaggucguguacgugaaggccggccuggucuccgacuuccggcacgaguucgaccuccccaaaagccgcuccuacaacgaccuacacaacgccgccgacgccuuccugagcgugguagccgguaacgucuacgacaugcgcuuuuccaaaaagugguuccgcaucgacgagaaguacagcgugaaggugaagaccaucuucacccacgaagucaagugccggggcgacaucauuugggacggcaugccgaugcucgagaagguggaggacaccgcccgcaaaaacacggcgcacuucgugaaguacgcggccuucaagaccgguggccuguuugaccagaaccccgucaagaaggggaccggccugaucccccucaaggcggggcugccgaccgagaaguacggcggcuauaauaaggccgggaucauguuccugauccccgugcgguacaacaucggcaagaaguccgagauccucauccugccgguggagcugaugcacgggaagcacuucuuggaagacaaggucuucgcgcgcaacuacaccuucacgcgucuggagaacauccugggcaagaaggugggcgaggugagcuucccgaugggcaugcgccccuggaagaucaacaccaugcucuccuucgacggcuucagaguaugccugaccgggacuagcggccgcgggaagugccugguggcccagcccgugaugcaguuuuccgccgacgagcacuggagauucuacgucaagcgccucgagcgcuucguggagaagaucggcaucaacccggaccugcucuacgacaaggaccacgacaagguuagcaaggacgagaaccucaagcucuacgagcuguacgucgacaagcuccagaacacaauuuacaagaagcgggugaacuccccggugcagacccugcugaaggggaaggaggaauuuaagaagcuaucaaucgaggagcagugccagguccuguugaacauccagucaguguucggccgcaugaccggcgggugcgaccucacccugaucggcgggagcgcccacuccgcagcgacgggcagccugagcaccaccauauccaacuggaagaagaaguacagcaccguccggaucaucgaccagucccccucuggcaugugggagaaguccagcgagaaccuccuagacuuccuguga

SEQ ID NO: 7715 - RNA, 4092 nt, Artificial Sequence
  Cas9 variant
augacaaaacucggaaagccguacggaaucggcgucgacaucggaucaaacucaauaggcuucgcagcaguagacgaaaacagccaucuaauccggcucaaagguaagacaguaauaggcgcccgacucuucgaggaaggaaaggccgccgcagacagacgagcauccagaacgacacgacgcagacucagccgaaacagguggcgccuuagcuuccuaagagauuucuucgaaucacacauaacaccgacagaccccaacuucuucaugagacagaaguacucagaaauuucuccaaaagacaaagcaagauacaaauacgagaaacgccuuuucaacgaccgcacugacgcagaguucuaccaacaauaccccacgauguaccaucugcgcaacaggcugcucacagacccauccaaggccgacgucagggaaaucuacuuugccauccaccacauccucaaaucccgcggacacuuccugaccagcggcuacgccaaagacuucaacacaaacaaagucgcucuaaacgagaucuuucccgcucugcaagacgccuacgcacaaguguacccagaccucgauauaaccuucgacgagaacaaggucaacgaauuuaaaacgguccuacucgaugaaaaagccacccccuccgauacccaacgcgcccucgucaacuuacuccuggccgaagacggagacaaagacauucuaaagcaacaaaaacaaguacuaacggaguucgccaaagcagucguaggauuaaaaaugaaacugaacgucgcucuaggcaccgaggucgacagcucugaagccacggcauggaauuucucccuaggccaauuagacgauaaaugggccggcaucgaauccgcaaugacugaugaaggcaccgaaauccuagaucaaauacgggaccucuaccgugcuagacuccucaacggcaucgucccagccggcaaaacccucucacaagccaagguagacgacuacgaacagcaccacgaagacuuagagcuguuuaaggacuaccucaaacaguuggaagacgauggcauggccaaagucauccggcagcuauacgaucgcuauauugauggagacgacgcuaaaccauucgugcgagaagacuuugucaaggcccucaccaaagaggugaccgcgcacccgaacgcaaaauccccugaacuccuugaacgacuuguacaaccagacuuuaugcuaaaacaacgcaacaaagcaaacggggccaucccaguccaaaugcagcagcgagaacuagaccagauaauuaaaaaccaaagcgucuacuacgacuggcuagccgcccccaacccuguugagaaacaccgacaauccaugcccuaucaacuagacgaacuucucaauuuucggaucccauacuaugucggcccgcuagucacagcgaaagaacagaaagccgcucaaggcggcgucuucgccuggauggucagaaaagaccccgacggcaacaucacccccuacaauuucgacgagaaagucgacagagaagccuccgcuaacaccuucauacaacgcaugaagaccaccgacacuuaccugauuggugaggacguguugcccaaacagucccuacuguaccaaagcuacgaggucuuaaacgaacuaaacaacguccgggucaaugacaacaaacucucguucgaccaaaagcaacaaguacugggggagcuauucgaacgacacaacacagucacaaucaagcaauucguugacaaccuccucgcacacggcgacuaugaccgcaucccugaaguacgaggucucgcggaugaaaagcgauuccugagcucucuauccacauauaaucaauuaaagggcauccuacacgaagcgaucgacgacucagacaagcaaacagacauugagaagaucauagccuggagcacaauauucgaagacaaagcuaucuuuaagacgaaacucaacgaaaucagcugguuaaccgcaggaaugauaaacucucucgcgaacauccgguaccgaggcuggggccaguucagccacaaacucuuaaacgagcuuacacucucgaccggacgcacagucuucgaggagcuccucaucuccucacacaaccuuaugcaaauccucacugacgaaguacucaaacagaaaauagccgaacucaaugcgcacgaacucaaggccuccggcaucuaugccgcaaucgacgacgccuauacgucacccucaaauaagaaagcacucagacaaguccuaucaguaaucgacgacaucaccaaugccgcgggccaagcacccaacuggcucuacaucgagacagccgacggggauggagucccgggaaaacguacuaauucccggcaaagaaaaauccaggagaucuacgcaaacgccgcgcaagaacucauuaccggaucgguccgcggggaacuggaagacaaaaucgcaucucgcgcggacuuuacagaccgccucguccuguacuucaugcaaggcggaagagacauuuacacaggcgaacccuugaacauugacaaccucucaucauacgauauagaccacauccucccccagucucuaaucaaggacaauucccuagauaaccggguacucguccacccacucguaaaccgcgaaaaggacacaaucuucgccuccacgcgcuucgccaagcaaaugaacggaauguggcgacaauggcacgcagcuggacuaauaagcagccguaaguuaaggaaucuucaaaugaggcccgacgagauagauaaauaugcuagcggauucguagcccggcaacuugucgaaacccgccaaauaaucaagcucacggaacagauagucgcugaccaauacccagacgcaaaaauuaucgcagucaaggccggccucagcucacagcuccgaaaggaacucgacuuccccaagaaccgcgagguuaaccacuaccaccacgccuucgacgccuuccuagcggcacgcauuggaaccuaccuccuaaagcgcuacccgaaccucgaaccguucuucaccuacggcaaguucaaaaagacggaagucaagaaacucaaaucacucaagagcuucaacuucaucagggacaugacccacgccaaagacaaaaucgucgcgaaggaaaccggagaaauagucugggauaacgccagcgacauaaaugaacucgaccgcaucuacaacuuuaagcgaaugcucauuacgcacgaaguccgguucgaaacagccagccucuuuaagcagacccuauacgcggccaaaaacaguaaaaaccgaggcgggucucgucaacucauaccgaagaagaagggguaccuuguagacaucuacggcggcuacacucaggaaacuggcucuuaccuaaguguagugcgacuaacgaaaaaggcaauguacgccgugguaaaaguaaguacacgggacgcugccaaacucgcugucgcaaagagcaucuccgaacaaaaagagaacgaaacacucaagaaaaucaucgacggcaaacuuuccaaaacaagcaagaaaggaaaaaccacccaccaacucuuugaaaucguccucccucgcgucggacaaaagacccucuucaaaaacagcaaauacaaccaguuccucguaaacagcgacacguacaugcacaacuaccaggagcuuuggaugccccgcgaauaccaacgcauguggaaagacauucuacucagcaaccacggcgacgcccaacucgaaggccagcuugaucagauauucaaauucauagugucacaagucaacuccuacuuuaaccuuuacgacauaaaccaauuccgaaagaaaaucgccgacgccacugacaaauucgccaagcuaccuacccacgacacggacaacgcgagaggcaaaaucgcaacaaucggccaacuccucaucgggcugcaagcaaacgcaaugcgcuccgaccuaagaaaucuagacauaaagacacccuucggccuccugcagaucggaaccggcaucacgcucgaccucgacacuagcaucauauaccagucccccacaggccuguucgagagagaggugccauuaacagaccucuga

SEQ ID NO: 7716 - RNA, 4092 nt, Artificial Sequence
  Cas9 variant
augcgcggcaacuaccacaucgggcuggacauaggcacguccuccaucgguugggccguuauagacgacaacgccaaggucaugcgggcgaagggcaagaccgccaucggagcacgccucuacaacgagggccagacggcggcagaccggcgccuguuccggaccacgcgccggcgccugaaccggcgcaaguggcggcucaagcugcuagacgagaucuucgaccccuacauuaccccgguggacgcggccuucuucgcccgccucaagcagagcaaccugucccccaaggaccagaaccgggacuggacgggcagcaugcuguuccccgaccgcacugaccggaaguuccacaaggacuaccccaccaucuaucaccuccgucacaagcugaugaccgaggaccaccaguuugacauccgggagaucuaccuggccauccaucacaucgugaaguaccgcgggaacuuccucaacaccaccccggucuccucuuucuccgugagcgacgugaaguucgacgagcaguucgaccggcugaacgagcuguacgcggccgucucgcccgacgaacccuucgccaucaacggcgauaacagcaaggcaaucgagacccuccugcuguccgacgagaccaagaaguucgauaagcagaagcagagcgccaagcucauccuguccgagacaggggacaaggcgcuugacaaggagaacaccaagguggccacccagaucagcaaggccauccucggcuacaagacccagcuggacgugcugcucaaguacgacgccauuaacuccagcgccuggaagaucgaacuggacgacgagaacaucgacgacacgcugcccgggcuccugucccagcuggacgagaaucgccaggagauggucagcauaauccaaaaccucuacgcacaggugacccugaaccagaucgugccgaacggcaugucccugagcgagagcaugauugagaaguacaacgcgcaccgggaccaccucaagcugcugaagcagcuugaggacaagauagacgaccccaaaaagaagaagggccuggaggccgccuacgacgccuacgucgggaagaacaugaagguggcgaaccaggacguguucuacgccuccguaaagaagaaccuggacgacagcgaccucgccaagcagaucgccgaccugaucgaggcccagaaguucaugcccaagcagcgcaccucccagaacggcgugaucccccaccaacugcaccagcucgagcuggaccagaucaucgagaaccagucaaaguacuacccguggcugaccgcggccaauccgaaccccaagcgcauccaccaggccaaguacaagcucgacgaguugguggccuuccggauacccuacuacgucgggccgcugguuacgcccgaggaacaggagaaguccgcgaaccagguguucgccuggaugaagcgcaagcagcccggcaccaucacccccuggaacuucgaccagaaggucgaccggauggccagcgccaaccgcuucauccggcgcaugaccacgaaggacacguaccucaucggcgaggacgugcugcccgacgccucccugaucuacgaacgguuuaaggugcugaaugagcuaaaccuggucaaggccaacuaccaccgccuggcccccgcccagaagcaggccgccuaccgggaucucuucgagaaccagaaaagcaucuccaccaagaagcugcagaacuacuuaguggaccagggauauuucaccgcgaagcccaagaucacgggccucucggaccccgagcgcuucaacucaagucuggggaccuacaucgacuuuaaagagaucuucggcgaccaggucgacaauccggaccggcaggacgacuacgagaagaucaucgagugguccaccguguucgaagaccgccagaucuacgaggcaaaacuucggacccucgacuggcugacggaagaucagauccaggcccugaagaccaagcgcuacaacggguggggccggcugagcaagaagcugcugacugggaucguggacgagaacggggagaggaucaucgaugucuuauggaacaccaaccaaaacuucaugcagguccagucccaggagaguuucgccaagcggauccacgaggccaacgcgaagcagaugaaggugacaggcguggaggacauccuggccgacgccuacaccagcccccagaacaagaaggccauccgacaggugauccggguagucgacgacauccagaaggcuaugggcgggguggcccccaccagcguguccaucgaguucaccagaagcgaagaccagaacccccgccggacccagagccgcgagucccagcugcagaacacguucaaggucgacgccaaggagaucguggacagcgaccucgugaccgagcuggagaccgucuccaagagcaaaaaggggcugaccgaccggcucuaccuguacuucacacagcugggcaaggacauguacaccggcgacccgcucaauaucgacgagcuuuccaccuacgauauugaccacauccuaccccaagcguuuaucaaagacgacagcuuagacaaccgcgugcugguguccaaggccgucaacaauggaaaguccaauaaugugccagugaaguuguucggcgguaagaugggaggguucuggaaggagcucgcggaccaccggcugaucagcaagcgcaagcugaagcaucuccuuaccgacccggacacgaucgacaaguacaccaugaggggcuucauccgccggcagcuagucgaaaccagccagguuaucaagcuaguggcccagauacugggcgacaaguaccagaacgacgacaccaagaucaucgaggucacggccaagaugaaccaccaaaugagagagaacuuuaagcuaaucaagaaucgggaggucaacgacuaccaccacgccguggacgcuuaucucaccgcguucgucgggcaguaccuguacaagcgcuaccccaagcugcggcccuacuucguguacggcaacuucaagaaguucaacgaggaccacgugucauuccgcuauuuuaacuuccugcacgagcugauggacgagaacaacaagcgcaucgucgagcccgagaccggggagguggugcuggagcgcgagccggccaucgccuacaugaagcgggucuaccacuucaaguucaugcuuaucagccaggagguguacacccgccgggacgccauguucaaccagacaaucuaccccgccaaggaggcgaaccgccggaagcugaucgccaucaagcacggcaagcccguggacgucuacggcggguacuccgggagcguggacgccuacauggccaucgugcgcauccacgacaagaagggggacaaguacaaggucgucggcgugcccaugcgcgcgcuggagauccucaacgccacccacgacaagaaggacuacgaugccaaacugaaacagauccuggucccgaaguucaccaaggugaaaaagucccggaagaccggagagaucacgaagaagguggaggacuucgagaucguccucggcaaagugauguaccgccagcuggugaucgacggcgacaagaaguucaugguuggaagcuccaccuaccuguacaacgcccggcaacucgugcugagcgacagcucccuagacacccucgccagcaaggggacccuggacuccgacgcggacucaaagcgauugguggcugucuacgacgagaucguggagaaggucgacaaguacuuccccuuguaugacaagaacgccuuccgguccgggcugcacaaaggccgcgacaaguaccuucuccugcccaaucggagcacguucaacggggccaagaaggugcacuccggcaagcgcgagauccugaacgagauccucaacggccugcaugccaacgcgacccuagggggccugaaggaccuaaaaaucagcacccccuucgggaagaugcagggccaguccgggaucccgcugagcuccaacaccaucaucugcuaccagagccccacgggccucuuugagcaccgggugucccugaaggaucuguga

SEQ ID NO: 7717 - RNA, 4092 nt, Artificial Sequence; identical to SEQ ID NO: 1917
  Cas9 variant

SEQ ID NO: 7718 - RNA, 4092 nt, Artificial Sequence
  Cas9 variant
augaccaagcugggcaagcccuacggaaucggcguggauauuggaagcaacagcauuggguucgccgccguagacgagaacagccaccucauccgccugaaggggaagaccgugaucggcgcgcgacuguucgaagagggcaaggccgccgccgaccgccgggccucacgcacgacccgucgccggcuuagccgcaaccgauggcggcuguccuuucugcgggacuucuucgagagccauaucacaccgaccgaccccaacuucuuuaugcgacagaaguacuccgagaucucccccaaggacaagucccgguacaaguaugagaagcgccucuucaacgaccggacggacgcggaguucuauaaguacgagaacugccccaccauguaccacuuaagaaaccggcugaugaccgacccgagcaaggccgacgugcgagagaucuacuucgccauacaccacauccugaaguccagggggcacuuucuuaccccaggcgacgcaaaagacuucaacacgaacaaggucgcggugaacaagaucuuccccgcacugcaggacgccuacgcccagguguaccccgaccuggacaucaccuucgacgagaacaaggucaacgaguuuaagaccgugcugcucaacgagaaggccaccccgucugacacgcagcgcgcgcuugugaaccugcugcucgccaaggaaggggaccgggauauacugaagcagcagaagcaggcccugaccgaguucgccaaagccgucgucggccucaagaccaagcugaacguggcgcuggggaccgaggucgacuccagugaggccacggccuggaacuucucccucggucagcuggacgacaaguggaccggcaucgagagcgcaaugacagacgaggggaccgaaauccuggaccaaauccgcgaccucuaccgcgccaggcugcugaacggcaucguucccgccggaaagacccucucccaagccaagguggacgacuacgcccaacaucacgaggaccuggaacuguucaaagacuaccucaagcagcuggaggacgacggaaccgcgaaggcaauccgccagcuguacgaccgguacaucgacggcgacgaugcgaagcccuucguccgagaagacuuugugaaggcccucaccaaggaggugaccgcccaccccaacgccaagagcccggaguuacuggagcggcucgcgcagcccgacuucaugcugaagcagcgcaacaaggccaacggggccauccccguccagaugcaacagcgagagcuagaccagaucaucaagaaccaguccguguacuacgacuggcucgccgcgcccaacccgguugagaagcauaggaaaagcaugccuuaccagcuggaugagcugcucaacuuucggauccccuacuacgucggcccccuggugacggcgaaggagcagaaggccgcccagggcgggguguucgccuggaugguccgcaaggauccggacgggaacaucacccccuacaacuucgacgagaagguggaccgggaggccagugccaacaccuucauccagcgcaugaagaccacugacaccuaccugaucggcgaggacguacucccuaagcagucucugcuguaccagcgguacgaggugcugaacgagcucaacaacgugcgcgucaacaacgagaagcugagcaucgagcaaaagcaacaggugauccgggagcuguucgagcgccacaacuccgugacgauuaagcaguucgccgagaaccuccgggcccacggagacuacgcccacaugcccgaaauacgcgggcuggccgacgagaagagguuccugagcucccucagcaccuaccgccaguuaaagucccugcucccggaagcgauugacgaccccgccaagcaggccgacaucgagaacaucaucgccuggagcacggucuucgaggacgcggccaucuucaagacuaaguugaaggagaucaacuggcuagacucccagaccaucaccaagcucagcaauauccgcuaccggggauggggucaguucucccacaaguuccuuaacggccugacgcucggcaacggccacacaaucauccaggagcuuuuucugucgaacaacaaccucaugcagauccucacagacgagacccugcagaagaagaugaccgagcucaacgccgauaagcugaaggcagccaacaucaacgaugccaucgaugacguguacacgucccccagcaacaagaaggcccugcgccaggugcugcggguaaucgaggacaucaagcgcgccgccgacggccaggacccuucguggcuguacguggaaacagccgaugggggcgggaccccgggcaagcggacacgggcucggcagcaccagcugcaggagaucuacgcaaaugccgcccacgagcucaucgacagcgccgugcgcggggaacuggaggacaagauugcagacaaggccgacuucaacgaucggcugguccucuacuucaugcagggcggucgagacaucuacaccggcacgcccuuaaacauagaccaacuguccucguacgacaucgaccacauccucccccagucccugaucaaggacaacagccuagacaaccgaguccucgugcacgcaaucaucaaccgcgagaagaacgccaccuucgcgagcaccaucuacgcccagaagaugaacgccaccuggcggcaauggcacgaggccggcuuaaucuccgggcgcaagcugcgcaaccuccagaugcgcccggaccagaucgauaaguacgccagcggcuucgucgcacggcagcugguugagacacgccagaucaucaagcugaccgagcagaucguagcagcccaguacccugagaccaagaucaucgcuguaaaggccggccucucccaccagcugcgggaggagcuggaguuccccaagaaccgcgacgugaaccacuaucaccacgccuucgacgccuuccucgccgcaagaaucgggacguaccuucugaagcgcuuccccaaucuccaggccuucuucaccuauggcaaguucaagaaggcggacgugaaaaagcugagaggguucaacuucauucgggacaucacccaugccgaagacaagauagucgugaaggacacuggcgaggugauuugggacaagaagcgcgacguagacgagcuugaucgcaucuacaacuucaagagaaugcucaucacgcacgaggugcacuuugagaaggccgaccuguucaagcagaccguguacggggccaaggauagcaaggaggccgguggcaagaagcaguugaucuccaagaagaagggguacccugucgacaucuacggcggguacacgcaggagaccgggagcuaccucuccguggugcgccugacgaagaaggcgauguacgcggucgugaagguguccacccgggaugccgccaaacuggcggucgccaaguccauuagcgagcagaaggagaacgaaacccucaacgacaucaucgacgagaagcuguccaagaucagcaaaaacgggaagaucacccacgagcuguucgagguggugcucccccgcgucggccagaaaacgcuguucaagaacuccaaguacaaccuguuccucgugaacagcgacaccuacaugcacaacuaucaggagcuguggaugccccgcgaguaccagaaaauguggaaggacauaagucucagcaaguacggcgacgcccagaccgaggaccagcuggaccagaucuucgguuuuaucgugagccagguaaacaguuauuucaaccuguacgacaucaaccaguuucguaagaagcugaacgacgccgccgacaaguucgcgacccuccccaugagggacacggacgacaugcagggcaaaaucgccacaaucgggcagcugcugaucggccuacaggccaacgccgcccggucugaccugcgcaaccuggacaucaagaccccgcucggguugcugcagauccccaacggcaucucucucgacagcgauaccuccgugguguaccagagccccacuggccugcuggagcgggagguccaccucuccgaccuguga

SEQ ID NO: 7719 - RNA, 4092 nt, Artificial Sequence
  Cas9 variant
augaccaagcugaaccagcccuacggcauugggcucgacaucggcagcaacuccaucggguucgccguggucgacgccaacagccaccuccuucgccucaagggcgagaccgcgaucggggcccgguuguuccgcgaggggcaguccgccgccgaccggcgcgagagccgcacgacccgccggaggcugucccggacccgcuggcggcucagcuuccuucgcgacuucuucgccccgcacaucaccaagaucgaccccgacuucuuccugcggcagaaguacuccgagaucagccccaaagacaaggaccgcuucaaguaugaaaagcgucuguucaacgaccgcacggacgcggaguucuacgaggccuaccccuccauguaccacuuacggcugcgccugaugaccgacgcgagccaggcugacccgcgggagaucuuccuggcgauucaccacauccugaagucccgcggccauuuccucacccccggggccgccaaggacuucaacaccgacgagguggaccugaagcacaucuuccccgcccuggccgaggcguacgcccagguguacccggaccucgagcugaacuucgacagcgcccuggccgacgacuucaaggccaagcuccuggacgaggacgccaagccguccgacauccagaaggcccuggucaaccuccugcugagcuccgacggcgagaaggagaucgugaagaaacggaaacagguccucacggaguucgccaaggccaucaccggccugaagaccaaguucaaccuggcccucggcaccgagguggacgaggcggacgccagcaacuggcaguucuccauggggcagcuggacgacaaguggagcaauaucgagacguccaugaccgaccagggcaccgagaucuucgagcagauccaggagcuuuaccgcgcccgccuccugaacggcaucgugcccgccgggaugagccugagccaggccaagguggcggacuacggccagcacaaggaggaccucgagcuguucaagaccuacaucaagaagcugaacgaccacgagcucgccaagacgauccgggggcuguacgaccgcuacaucaacggcgacgacgccaagcccuuccugcgggaggacuucgucaaggcccucacgaaggaggugaccgcgcaccccaacgagguguccgagcagcugcugaaccgcaugggccaggccaacuucaugcucaagcagaggaccaaagccaacggggccaucccgguccagcugcagcagcgcgagcuggaccagaucaucgccaaccagagcaaguacuacgacuggcucgcgaagcccaaccccguggagaagcacagggccuccaagcccuaccagcuggacgagcugcugacguuccgcaucccguacuacgugggcccccucauaacccccaagcagcaggccgagagcggggagaacgucuucgccuggaugguacggaagaaccccuccggcaacaucaccccguacaacuucgacgagaagguugaccgcgaggccagcgcgaacaccuucauccagcggaugaagacgaccgacaccuaccugaucgacgaggacguccugcccaagcagucccuccuguaccagaaguacgaggugcugaacgagcucaacaacgugcgcaucaacaacgaggcccugagcaccgaccagaagcagcggcugaucagagaggucuuugagcggcacuccagcgugaccaucaagcaggucgccgacaaccucguggcccacggggacuucgcccaacgccccgagauucggggccuggcggacgagaagcgcuuccuguccagccucuccaccuaucaccagcugaaggagauccugcacggcgcaaucgacgaccccaccaagcuccacgacaucgagaacaucaucaccuggagcacgguguucgaggacgccgccaucuucaagaccaagcuggcggagaucgacuggcuggacccggcuaccaucaagaagcucuccaacauccgguaccgcggguggggccaguucagccgcaaguuacuggacgggcucaagcugggcaacgggcauaccgucauccaagagcugaugcucuccaaccacaaccugaugcagauccuggccgacgagacgcucaaggagaccaugaccgagcugaaccaggacaagcugaagaccgacgacaucgaggacgugaucaacgacgccuacaccagccccuccaacaaaaaggcccuccgccaggugcugcgggucguggaggacaucaagcacgcggccaacggccaggaccccagcuggcuguacaucgagacggcagacggccccgggacagccggcaagcggacccagagccgccagaagcagauccagacuguguacgccaaugcggcccaggagcucaucgacuccgccgucagaggggagcuggaggacaagaucgccgacaaggccagcuucacggaccggcuggugcucuacuucaugcagggcggccgggacaucuacaccggcgcgccgcugaacaucgaccagcugucccacuacgacauugaccauauccucccccagagccugaucaaggacgacucccuggacaaccgcgugcucgugaacgccaccaucaaccgggagaagaacaacguguucgccagcacccuguucgccggcaagaugaaggcgacguggcgcaaguggcacgaggccgggcugauauccgggcggaagcuccgcaaccugaugcugcgacccgacgagaucgacaaguucgccaagggguucguggcacgccaacucgucgagacccggcagaucaucaagcugaccgaacagaucgccgcggcccaguacccgaacaccaagaucaucgccgugaaggccggccugagccaccagcuccgcgaggaacuggacuuccccaagaaccgggacgugaaccacuaccaccacgccuucgacgcguuccuggccgcccgcaucggcacguaccuccugaagcgauaccccaagcugacccccuucuucaccuacggggaguucgcaaaggucgaugugaagaaguuccgcgaguucaacuucaucggcgccuuaacccacgcgaagaagaacaucaucgccaaggacacgggggagaucgugugggacaaggagagagacauccaggagcuggaccgcaucuacaacuucaagcgcaugcugaucacccacgaggugcacuucgacauggccgaccucuucgaccagacgaucuacgccgccaaggacuccaaggagcggggcgggagcaagaaccugauccagaagaagcagggcuaccugaccggcaucuacgggggcuacuccacggagcgugggagcuacgucuccaucauccggaccuucaagaagggcgcuccgaucuacaacaucgugaacaucagcaccgccgacgucuccuuacugucagacaagcagcgcguguccgaggccagcgccgacgugcugcucaaagagcugaucaagaagaagcucgcgaagcgcaaguccggggagaacaccaaguccggcgccuucgagaucguccucccccgggugggcaagaacacgcuguucaagaacaagaaguacgggcuguuccucguagagagcaccaccgaguuccacaacuaccaggagcuguggcugccccggaacgaucagaugcucaucaaguccauccagagccacaagaucgaggaaucgaaggccgacuacgagcugacccgcauguaccggaacaucgccagccaggucgaccacuacuuuggccuguacacgauccgcaaguucuccgagaagcucaccgccagcaucaacgacuacggcgcgcugcccguguacaagagugagaccaccgacggcaaguacgaggugcugagcaaccucuucgaggggcugggcuccggcacgagcaccgggaaccugaccgccgucaagcuccagccgaacuucggcaggguguaccugaccuccgggauagugcuggaggacgacacgagcaucaucuaccagucccccaccggccucuucgagcgcagcgucaagcuggccgaccuguga

SEQ ID NO: 7720 - RNA, 4092 nt, Artificial Sequence
  Cas9 variant
augaccaaacugaaccagcccuacggcaucgggcucgacaucggcagcaacuccauaggguucgcaguggucgacgccaacagccaccuccugcgcuugaaaggggagacagcgaucggggccaggcuguuccgcgaggggcaauccgccgccgaccggcgcggcagccggacgacccgccggcgccugucccggacccgcuggcggcucagcuuccuacgcgauuucuuugccccgcacaucaccaagauagaccccgacuucuuucuccggcagaaguauuccgagauuagccccaaggauaaggaucgcuuuaaauacgaaaagcggcuguucaacgaccgcacggaugcggaguucuacgaggacuaccccuccauguaccaucugcggcugcaccuaaugacccacacacacaaggccgacccgcgcgagauuuucuuggccauccaccacauccuaaagucgagagggcacuuccucacacccggcgcagcgaaggacuucaacacggacaagguggaccuggaggacaucuuccccgcccugaccgaggccuacgcccagguguaccccgaccucgaguuaaccuucgaccuggcgaaggccgacgacuucaaagccaaguugcuggacgagcaggccaccccguccgacacgcagaaggcccuggucaaccuccugcugagcucagacggggagaaggagaucgugaagaagagaaagcaaguccucaccgaguucgccaaggcuauaaccggucugaagaccaaguucaaccuggcucucgggacggaggucgacgaggcugacgccagcaacuggcaguucuccaugggacagcuugacgauaaguggagcaacaucgaaaccuccaugaccgaccagggcaccgaaaucuucgaacagauccaggagcuguaccgggcucgcuugcugaacgggaucgugcccgccggcaugagccugucucaggcuaagguggccgacuacggccagcacaaggaggaccucgaacuguucaaaacguaccuuaagaagcugaaugaccacgagcuggcgaaaaccauacgcggccuguaugacagauacauuaauggggacgacgccaagcccuuucuccgugaggauuucguuaaggcacucaccaaggaggucaccgcccacccaaacgagguaagcgagcaguugcuaaaccggauggggcaggccaacuuuaugcugaagcagcgcacuaaagccaacggcgcgauaccgauccaauuacaacagagagagcucgaccagaucaucgccaaucagagcaaguauuacgacugguuggccgcccccaaccccgucgaagcccaccguuggaagaugccguaccaguuagacgaacugcucaacuuccauaucccuuauuacguggguccccugaucaccccuaagcaacaggcggaguccggcgagaacguguucgccuggaugguccgcaaggaucccagcgggaacaucaccccguacaacuucgaugagaagguggaccgggaggcauccgcuaacaccuuuauccaaagaaugaagacuaccgacaccuaccuaauaggggaggacgugcuccccaaacagucucugcuguaccagaaguacgagguccucaacgagcugaacaacgugcggauaaacaacgaaugccugggaaccgaccagaagcagcgccucauccgcgagguguucgagcggcacuccagcguuacgauaaagcaagucgccgacaaccugguggcucacggggacuucgcgcgcaggccggagauccgcggccuggcagacgagaagcgguuucuguccagccugucuacauaucaccagcuaaaggagauccuccacgaggccaucgacgaucccaccaagcugcuggacaucgagaacaucauaaccuggagcaccguauucgaggaccauaccaucuucgagaccaaguuagccgaaaucgaguggcuggacccgaagaagaucaacgagcuguccggaauccgcuaccggggcuggggucaauucagcagaaagcugcuggacggccugaaacuuggaaacgggcacaccguuauccaagagcuuaugcuguccaaccacaaccucaugcagauccuggcggacgaaacgcugaaggagacgaugaccgagcucaaucaggacaagcugaagaccgacgauaucgaggaugugaucaaugaugccuacacaagccccuccaacaagaaggcccugcgacaggugcuccggguuguagaggacaucaaacaugccgcgaacggucaggaucccagcuggcuguucaucgagacggccgacgggacgggcacggccggaaaacgcacccagucacggcagaagcagauccagacgguguacgccaacgcagcgcaagagcugaucgauagcgccguccgcggcgaacucgaagacaaaaucgcagacaaggccuccuucacugaccgguuaguccuauacuucaugcagggcgggcgcgacaucuacacgggggcgccccuaaacaucgaccagcugagccacuacgacaucgaccacauccugccacaaagccucauuaaggacgacucccuggacaaccgggugcuggugaacgccaccaucaaccgcgagaagaacaacgucuucgcuagcacucuguucgccggaaagaugaaggccaccuggcggaaguggcacgaggccggccuuauaagcggccgcaagcugcggaaccucaugcugcgccccgacgagaucgacaaauucgcgaagggguucguggcgcggcagcugguugagacacgccagaucaucaaacucaccgagcagaucgccgccgcccaguaccccaacacgaagauuaucgcugucaaggccggccugagccaccagcugcgggaggagcucgacuucccgaagaaccgcgacgucaaccacuaccaccacgccuuugacgccuuccuugcggcgcggaucgguaccuaccuguugaagcgcuaccccaaacuggcacccuuuuucaccuacggcgaguuugccaagguagacgucaaaaaguuccgggaguucaacuucaucggggcccugacccaugcgaagaagaacaucaucgccaaggacacgggcgagauugucugggauaaagagcgcgacauccgggagcucgaccgcaucuacaacuucaagcgcauguugaucacccacgagguguacuucgagaccgccgaucuguuuaagcaaaccauuuaugcagccaaagacuccaaagagcggggcgggagcaagcagcucaucccuaagaaacagggguacccgacacaggucuacggcggguacacccaagaauccggguccuauaacgcgcuggugaggguggccgaggccgauacgaccgccuaccaggucauaaagaucuccgcccagaacgcaucaaagaucgccuccgccaaccucaagagcagagagaaggggaagcagcuacuaaacgagaucgugguuaagcaguuagcaaagcgccggaagaacuggaaacccuccgcgaacagcuucaagaucgucaucccccgcuucggcauggggacgcuuuuccagaaugccaaguacggccuguuuauggugaacagcgacaccuauuacagaaacuaccaggagcuguggcucagccgcgagaaccaaaagcugcugaagaagcuguucuccaucaaauacgagaagacccagaugaaccacgacgcccugcaaguguacaaggccaucaucgaucaggucgagaaguucuucaagcuguacgacaucaaccaguuccgggccaagcugagcgaugcgaucgagcgcuucgagaaguuaccgaucaacaccgacgggaacaagauuggaaagacggagaccuugcggcagauccucaucgggcugcaggccaacggcacccgcagcaauguuaagaaccugggcaucaagaccgaccucgggcuguuacaaguuggcucagggaucaagcuggacaaggacacgcagaucguuuaccaaagcccguccggccuguucaagcggcguauaccccuggccgaccucuga

SEQ ID NO: 7721 - RNA, 4095 nt, Artificial Sequence
  Cas9 variant
augggcgacaggaaguauaaccugggguuggacaucgggacgagcuccaucggauuugccgccguggacgaaaacaaccagccaauccggguuaagggcaagaccgcgaucggggugcgccuguucgaggagggcaagacagccgccgaccggagaggcuuccggaccacucgccggcgccugucccggcggcgguggcgcaucaaucugcugaacgagauauucgacgcacaccuggccgagguugaccccaccuuccucgcgcggcugaaggaauccaacaggucaaaccuggaucccaaaaaguccuuucagggaucgcuccuguucccggagcgaaaagacuaccaguucuaugaggaauaccccacgaucuaccaccuucgcaaagcccugauggagaaagaucggaaguucgacuuccgcgagaucuaucuugccguccaucacaucaucaaguaucguggcaacuuccugaacgggaccccgaugcgcuccuucaagguggagaacaucgagcuggacacccuguucgaccagcuaaaccagcuguacgcggagauagugcccgacaacgaacuggcuuucgaucuggcccagguggccgacgugaaagauguccucagcuccaccaccaucuacaagauggacaagaagaagcagcuggugaagaugaugcugcuccccgccagcaacaaggcccuacaguccgagaauaagaagaucgucacacaauucgugaacgcgauccugaacuacaaguucaagcucgacgucuuauugcaaguggaaaccgacgcagacuggagccugaagcugaacgacgagggugccgacgauaaacuggaggaguucaccggggaccucgacgagaaccggcuggagaucauagaccuacuccagcgcuugcacaacugguucucucuaaaugagaucacgaaggacggcaauagccucuccgccgccaugguggaaaaguacgagaaucaccaucaccaccugggccuucucaagaaagucauagagaaucaccccgacgcgaagaaggccaaagcacugaaggagaccuacaccgccuacguggguaagacagacgauaagacacagaaccaggacgacuucuacaaggccguggagaagaaccuggacgacagcccagacgcgaaggagauuaagcgccucauccagcuggaccaguucaugcccaagcagcggaccggccagaacggggcaaucccccaccagcuccaccagcaggagcucgaccagaucauugaaaagcaguccaaguacuaccccuuccuggccgagccgaaucccaaugucaaacgccggaaggaugcgccguauaagcuggacgaguuaaucgcuuucaagauccccuacuacgugggcccgcucgugaccccggaggagcaggcgcagaacggcgagaacguguuugccuggaugaagcgcaaggccgccgggcccaucacccccuggaacuucgacgagaagguggaccggauggagagcgcaaaucgcuucauccgucgcaugacgacuaaggacaccuaccuguucggcgaggacguccugccggccgaaucaaugaucuaccagaaguucguagugcucaacgagcugaacaacuuaaagaucaacgggcggcaccucucccugaaggacaagcaagacgucuacaacgaucuguuuaagcagcagaagaccguuagcaucaaggcccuccaaaauuacuacgugacgaagaagaaagccgccaccgcgcccaccgucggcgggcuggccgaucccaagaaguuccuguccagucucuccacguacaucgacuuuaagaacauguuuggcgagcguguaaacgauccccaguuucaggaggaccuggaacagauuguggaguggucgacgaucuucgaagacagaggcaucuuuaaggcgaaauugcaggcccucggguggcuguccgaaaagcagauccaacagcuugucgccaagcgcuauaagggcugggggcggcucagcaaaaagcugcugaccggccucaagaacgcggaaggguacucaauccuggaugagauguggcgcaguaccggcaacuuuaugcaaauccaaagucggccggaguucgccgcccugauacaacaggccaacgaaaagcaguucgaaggcaacgaccccgacaacgugugggaaaacaucgagaacauccucggagacgccuacaccagcccccagaacaaaaaggcgauacgccagguggucaagguggugcaggauaucgagaaggccgucggcaacccucccgagaagaucgccaucgaguuuacgcgagaggcugcggccaacccccaacgcacucaaucccggcugcgcacccuggaaaaguuguacgagagcgccgaggaggucguugacgcugggcugaccgccgagcuggcggaguucaaggaaaacaaacacguucucuccgauaaguacuaccuguacuucacgcagcugggacgcgacguguacacaggggacaccaucagucuggacaagcugaacgacuacgacguagaccacauccugccccaauccuucaucaaggacgacucucucgacaaccgcguccugacaauaagagcagugaacaacggaaaaagcgacaacgugcccgcuaagauguucggcaagaagauggggucauucuggcgguaccuacucgacaacggcaugaucuccaagcgcaaauacaacaaccugauaaccgaccccgacaacaucagcaaguaugcgcagaagggcuucaucaaccgacagcuggucgagacgucccaggucaucaaauugaccgccaauauccugaauggaauuuacgacaaggacacggagaucauagaggugcccgcgaagaugaacagucaaaugcgcaagauguucgaccuggucaaggugagggagguaaacgacuaccaccacgcguucgaugccuaccucaccaucuucaucggaaacuaccuguacaagugcuaccccaagcugcaaccguacuucgucuaugacaacuucaagaaauucgggaacaaagaggauaucggucacaagcgcuucaacuuucucgggaagaucgagcgggagaagaaagugguggccccggagacgggcgaaauccucuggaguaaugucgcccccaacgagaccaucaagcaaaucaagaaaguguacgacuacaaguucaugauaguaucccgcgagaucaccacccggcgcgcggagcuauucaaccagacagucuaccccaagaacuaucacgggaagcucauuccgaucaaggaggaccgacccaccgaccuguauggcggauacagcgggaacaccgacgccuaccuggccaucguggcccuagaggacaaaaagaagggcaaguacuucaagguggucgggauccccacccgcguugcggcaaagcuggagaagcugaagcagcaggacucccagcaguaccuccaggcccuccacaaggugauagcgccccaguucaccaagucgacgaagaaaggcaucaaaaagaccgaguucgagaucguccuggacaaggugcacuaccggcagcuggugcaggaugggccggucaagaugaugcugggcucaaguaccuacaaguacaaugcaaagcaacuggugcucuccgagaaggcccuucaggugaucgccgacgaccgcaaguucgaugaaacacagaaggaugacaaucugaucgccgucuacgacgagauacugucuaucgucaaucaaucuuucgacuuguacgacaucaauggcuuucggaagaagcuaaacgacaaucgcgaccaguuuauagauuugcccgccgagaccaaguacgagggacggaaggugguagcccacggcaagcgcgagaugauccucgagauccugaaggggcuccacgcgaacgccgccuucgguaaccugaagcccaucggguucuccacugcguucggccaacuccaggugcccaacggcauuauccuguccaaaaacgccauccugauucaccagagcccguccgggcuguuugagcggaagaucaagcucagcgaccuguga

SEQ ID NO: 7722 - RNA, 4095 nt, Artificial Sequence; identical to SEQ ID NO: 1922
  Cas9 variant

SEQ ID NO: 7723 - RNA, 4095 nt, Artificial Sequence
  Cas9 variant
augaacaagcgcuacaacaucggccuggacaucgggaccaacaguaucgguuggagugugguaaacgaccagagccagcucgugcgcauuaaggggaagcuaggcuacgguguucgcuuauaugacgagggccaaaccgcugaggaccggcgccucuuccggacgacccgccggcgccugaagcgccgcaaguggcggcugggccuccugcgcgagauuuucgagccuuacaucacgccccaagacgccaccuucuuccugcggcagaagcaguccaaccucagccccaaagaccugcagaagcagcagccucaaauugggcuuuucaacgaccgacucgacucggacuuccacuaccaguaccccacgaucuaccaucuccgauacgcgcugaugacugagaaacgccaguucgaccuccgggagaucuaccuggccaugcaccacaucgucaaguaccgaggccacuuccugaacgcagccgccgcgagcuccuucaagucgggugagauugaccucgccaaggacuucgccgcccuaaaccagaucuucggcaccaucuuuuccgaggugggguucucucugucggagucuaacuuggacgagaucaaguccauccugcuagacaacaaccucagcgcguccgugcggcaacggaaggcccugccgcuaauauaucagaccgcagccagcaaggacuccgagaaacaguacaaggccaucgcgacggagcuccuuaaggccauccugggccucaaggcaaaguucaaccugaucaccggcauugaggucgaggacgugaaagccuggacccugagcuucaacgccgaggacuucgacgcgaagcucuccgaccugaacaucgccgacaacgacgaugcugugcagaucaucgagauccugcgggcgcucuauucugggguccugcugaccggaauagugccggaggggcagagcauuucccaggccaugaucgacaaguacgaggcgcacaaagcccaccuuaucaugcugcgcagcauccgugaacaacuguccgacaaggagaauaaggcgcucgagaaggccuacgacgacuacaucgaccaccccgaggacaagcagcacggcagccgugaggacuuuuacgccgcgaucacgaaggugcugaagaaggauucagaggacaccaacaucaucgagauccugaagcucauagagcucgaccaguucaugccgaagcagcgcacaaaggacaacggcgccaucccgcaucagcuucaucagcaagagcucgaccaaaucauagagaaccagaagcaguacuaccccuggcucgcagacaucaaccccaacgagcagcggcagaaaauggcccccuacaagcuggacgagcuggucaccuuucgcgugccguacuacgucgggcccaugaucacggcggaggagcaguuccagaccagcaacaagaaguucgccuggaugauccggaaggagccaggcgccauaacccccuggaacuuugaccagaaggucgaccgccaggccuccgccaacgaguuuaucaaacggaugaccacgaccgacaccuaccuccuagcggaggacgugcugccgaaacagagcuuacuguaccagcgcuucgaggugcugaacgagcucaacgguaucaagauugacgaccagcccaucacagucgagcagaagcaagcuaucuucaacgacaaguucaugcagcaggcacacguuacagucaaaaacauccaggccuaccugguauccgagggccaguacgcaagccgaccaaacaucaccgggcugucugauggcgagaaguucaacuccaguuuaagcaccuaccaugaucuuaagaagaucuucggcgacaugaucgacgaccccaacaagcagaccgacuuugagaagaugaucgaguggaguacgaucuucgaggacgggaaaaucuucgcugauaagcugcgcgagaucaacuggcuaaccgacgagcagcggcagcgccugagcaacaagcgguaccgcggcuggggacagcuauccaccaagcuccugaccaagaucguggaccagaacggccagcggaucaucgacauccuguggaacacuaaugacaauuucaugcgcaucauccacagcgacgacuucgaccaggccgugacccaggccaaccagaugcuccuggccgacaacgacacgcaagacgucaucaacgagcuguacaccuccccgagcaacaagaaagcccuccggcagauccuucucgucguugcugacauccagaaggcaaugaaggggcaggcccccgcccgcauccucaucgaguucgcgagagagaaacaggccaacccccgccugagcacgcagcgccggcgccagguggagcaggucuaccaggagcugaacaacgaccagcucaacaaagagcuggcagacccccaguacgccaaccuguccaaagaccggcuguuccuguacuucaugcagggcggccgcgacauguacacgggggagagccugaacaucgaccggcucagcgaguacgacaucgaccauauucugccgcaggccuucaucaaggacaacucucuggacaaccgcguguuaguguccgcgaagaugaaccggucgaaguccgaccacgugccccuggacuucaccgaggagcgcuucggccagaagaugaggucacagugggagcagaugcuccgcgccgggcuccugacccggcgcaaauacaacaaccugacccucaaccccgacucccucaacaaguacacgaugagcggauuuaucaaccgccagcuggucgagaccagacaggugaucaagcucgccaccaaccugcugguagaccaguacgccgacgaggacguccaacucgugaccgucaaguccgggcugacgcaccagaugagagaggacuucgacuucccgaaaaaccgcaaccugaacaacuaccaccacgcuuuugaugccuaccucaccgccuuugucggccuguaccuccucaagaaguacccaaaacuagcccacuacuucguguacggccaguaccagcagggguucaaggccaacgaccaguggcggaacuucaacuuccugaauggccuccgccaggagcaacaggucgacgccgagaccggggagcugaucuggcagaaggaccacgaccuggccuacaugaacaagaucuacgacuucaagaagaucuuggugaccagggagguccacacgaaccacggcgcgcucuacaaccagacgcuguacaaagccaaggacgacaaggcaucuggucagggcgggagacagcuaaucgccgccaaggagaaccggcccaccgccaucuauggcggcuacuccgggaagaccguggcauacaugugccugguccgcaucacagaaaagaagggugacuucuaccgcaucugcgguguucagaccgccuggguggaugagcuggaacacaucgaagacgcaaccaucaagcuccagcggcugaccgcccugcucacgccccaguucagcgccaccaagaagcagaaggacgagguagugaccguggucaagccguucgaaguacugcugccgaagauccucaucaaccagcgguuuuaugacgggggccaggagcugacccuggcguccgccacguacaagaacaacgcgcaggaguuggugcuggacaagaaggccguccaggugcugaacgggcagcuccccaaggccgagcuggaggcccaagccaccguggucuaugaccaaauccuggagcggguacagaaguauuucccccucuacgacaugaacucauuccgcgagaagcuguucgugggccgggacaaguucaacgaguugccguggcaggaccagugggagaaccacaagcucauacaggugggacagaagacaaucuuggaccgcauccugaucggccuccacgcgaacgcugcuaugggcgaccuuaaggcccugaacauguccacccccuucgggaagcuccaaaaguccaacggcaucagcuuaagccccgagacgcagaucaucuaccagucgcccaccgggcuguucgaaaggcgcguggcgcuuaaggacuuauga

SEQ ID NO: 7724 - RNA, 4095 nt, Artificial Sequence; identical to SEQ ID NO: 1924
  Cas9 variant

SEQ ID NO: 7725 - RNA, 4098 nt, Artificial Sequence
  Cas9 variant
auguacaagaaggacuacaccgugggccuggacaucgggagcaccuccgucggcuucgccgccaucgacgacgacuaccagcccauccgccucaaggggaagcgggugaucggcgugcggcuguucgaggaggggaagacggcggccgagcggcgcaacuuccggaccacccgccggcgccugaaccggcgaaaguggcggcucagccugcuggaggagaucuucgacccguacauggcgaaggucgacccgaccuucuucgcccgccucaagcaguccaaccuguucccaaaggacaagaacaagaaguucacgggcagccuccucuuccccaagaccaccgacuccaaguucuacgaugaauacccgaccaucuaccaccuccgguaccaccugaugaacgacagccgcaaguucgaccuccgggagaucuuccuggccauccaccacaucgugaaguaccgcggcaacuuccugaacuccgcgcccaucgccagcuuuuccacggacaagaucaaccucguggacgacuucgagaccgucaacgccgccuaccugcagaucaacagcuccaaccccgugcagcuggacaccgaccaggcggaccaggugagccggauccuccuggacaauaagcuguccaaccucgacaagcagaagcaggccgccaaggcccuggcccagaaguccggggacaagaagcaggacaagaucaacaacaccacuaucaaacagaucugcaaagcguugcucggcuacaaguucgaccuggccgucgugcugaacaucgacagcgacgaccacaacaaguggaagcuccagcugagcgacgagaacaucgacucccgccucgccgagcucaccggggagcugaacgaggcccagcuggacauccucaaugugcugagccggcuguacucccagaucacacucaacgacaucguccccagcggcaugacccugagcgaggccaugaucgagaaguacaaggcgcacaagaagcaccugaagaugcugaaggacuucgcccgcucgcugucuaagaaagacuauggccaagugauggaggccuacgccgaguacaucgggaacaucccggaguccgccagcuccaaggcgcagaagaagaucagccaggacgacuucuacaagaagaucaagcgguaccuggacgacuccaagcucggccagaagaucgccgagcugaucgccaagaacgaguucaugcccaaacagcgcacgaaucaaaacggggugauccccuaccagcugcaccucaaggagcugaaccagaucaucgagaaccagagcaaguacuaccccuggcuggccgagcucaacccgaacgagaagcgccggggaaaggccaaauacaagcuguccgagcuggucgcguuccgcauccccuauuacguugggccccugaucacgcaggaggagcagcagaagaccagcaacgccaacuucgccuggaugauccguaagucggagggccgcaucacccccuggaacuucgacgagaagguggaccguaucgccacggcgaaccgcuucaucaagcggaugaccaccaaggacaccuacuugaucggcgaggacguccugccggcccacucacuccucuacgagcgcuucaaggugcugaacgagcugaacaugauccgggugaacaaccaccgacucuccgucgggcagaagcaagacguguucgagaagcuguuccagaagcacaagacggugaagacccgggagcugaucaagcagcucauggccagcggccuacccacccagccccgcaucacggggcuguccgaucccgccaaguucaacacgagccucggcaccuacaacaacuucgccaagauccugggggacgagaucaaccagccggaccggcaggaggacuucgagaagauuaucgaguggaucaccaucuucgacgacaaggacauccugaagaccaagcucuccgagcugagcuggcuggacgagaagcagaucaacgcgcucaucaacaagaacuacuccggcuggggccgccugagccggaagcuguuaacggagcugaccaacaagaaggggcagagcaucaucgaccgcauguggaacacccagaaguccuuuauugaaaucaucaacgagcccgucuucgccgagcagaucaaggacgccaaccaggaccagcuggacgaggacgacuacgagaccgugcuccacgacgccuacacgagcccccagaacaagaaggccauccggcaggucaucaagguggucgacgacaucgucagggcggccggccgggcccccaaguucauuucccuggaguucgcccgcgaggaccaggagagccgccggacccagucccgccugagccggaucaagaagaucuacgagaccaccaccaaggagcucguggccaacgaccagauccgggaggagcuggggaaugugaaggaccugaacgaccggcuguuccuguacuucacgcagcugggccgcgacgcauacacaggggagcggaucaacaucgacgacaucuccaccaaguacgacaucgaccacauauucccgcgcgccuucaucaaggacgacagccucgacaacaagguccuggugaagagagccgugaacaacggcaaguccaacaacgucccccugaagcuguucggcgccaagaugaaacccaucuggaagauguggaaggaccaccagcugaucagcaagcgcaaguacgagcaccugaugaccaaccccgaugcgaucgacaaguacaaggccaacggguucaucaaccggcagcucauugagacgcgccagaucaucaagcucgcugccaacauccuggccaaccgguacuccaccgaggacaccaaaaucaucgaggugaaggcgaaccucaaccaccagcugcgccagagccugcaccucuacaagaaccgccaggugaacgacuaccaccacgccguugacggcuaccucuccgccuucguggggcaguaccuguaccaucgguacccgagccuccaguccuacuucguguacggccaguaccagcgguucuucgacaagcagguccaggagaacaugaaauucaaccgcuucaacuuccuguacgaccugaccgaccgggacaacgaccagaucguggucaagagcacgggggagaucgugggcgagaaguccaagcucaucgagcagaucaaguggguguacagauacaaauucaugcuggugagccaggaggucuucaccaagaccggcccccuguucgaccagaccaucuaccccgccgggagcaacaagucccggcucaucccgaucaagaaggaccgccccacggacaucuacggcggguacagcuccagcaccgacgccuacaugucccugauacgcgugccggacaagaaggaggacaaguacaagguggucggcgugcccagccggucccuggcgagccucaaccgcgccgagaaacggggccacgacgccuaucuggaccaacugcgucaggugaucgccaagucucagaagaaggaguuccagaucaucaucccgaagcucagguaccgccagcugaucaucgacgggggccugaaguacacccucgggagcuccgccuaccaguauaacgcgcggcagcugguccugagcgagaaguccauggaggugcuagugaccgacuucagcaaggucacgaccgacuuggacaagcagaaccagaagcugaucgccguguacgacgacauccucgacaaagugaaccgcugccugccccucuacgacaagaaccaguuccggaaggcccucaacggcgcccgcgacaaguucguccagcugcccauccugcccaaguucaacgggaacaagaaggaggaggcgggcaagguggagauccucaacgagauccuguuaggccuccacgacgacgccuccaccgggaaccugaagccgcugggcaucaagacccccuucgggaugcuccagacgcagagcggcaucaccaugucgagcaacgccgugaucgucaaccagucccccaccgggcuguucgagcaccggaucuaccugaaggcccuccugaacaagcugaacaaguga

SEQ ID NO: 7726 - RNA, 4098 nt, Artificial Sequence
  Cas9 variant
augaccaagcuaaaucagcccuacggcaucggguuagacaucggcagcaacuccauaggguucgccguagucgacgccaauagccacuuacugcgccuaaagggcgagaccgcgaucggugcccggcuguuccgcgagggccagagugcagccgaccgacgcggcagcagaacgacccgccggcgccugucccggacccgguggcggcucagcuuucugcgcgacuucuucgccccgcacauaaccaagaucgaccccgacuucuucuugcggcagaaguacucugagaucagccccaaggauaaggauagguucaaguacgagaaacggcuguuuaacgaccgcacggacgcggaguucuacgaggacuaccccuccauguaccaucuacggcugcaccuaaugacccacacccacaaggccgauccgagggaaaucuuccuggccauccaccauauccucaagagccggggacacuuccugacccccggcgccgcaaaggacuucaauacggacaagguggaccuggaggacaucuuccccgcccugaccgaggccuacgcccagguguacccggaccucgaacuaaccuucgaccucgccaaggcggacgacuucaaggcuaagcuccucgacgagcaggccaccccgucugacacgcagaaggcccuggucaagcucuugcugagcagcgacggggagaaggagaucguuaagaagcgcaagcagguccucaccgaguucgcgaaggcgaucaccggccugaagaccaaguuuaaccuggcccucggcacggagguggaugaggccgacgccagcaauuggcaguucuccaugggccagcuggacgacaaguggagcaacaucgagaccuccaugaccgaccaggggacugagaucuucgagcagauccaggaguuguacagagcccgccucuuaaacgggaucgugccggccggcaugagccugucccaggccaagguagccgacuaugggcagcacaaggaggaccucgaguuguucaagacguaccugaagaagcucaacgaccacgagcuggccaagaccauucgcggccuguacgaccgcuacaucaacggugacgaugccaagcccuuccuccgcgaggacuucgucaaggcccugaccaaggaggugaccgcccaccccaacgaagucagcgagcagcugcucaaccggaugggacaggccaacuuuaugcugaagcagcgcacaaaggccaauggcgcuaucccggugcagcugcagcagcgggagcucgaccagaucaucgccaaccagagcaaguacuacgacuggcuggccaagcccaaccccguggagaagcaccgcgccuccaagcccuaucagcuggacgagcugcucaccuuucggaucccguacuacguugguccccugaucacccccaagcagcaggccgagagcggagagaacgucuucgcguggauggugcgcaagaaccccuccgggaauaucaccccauauaacuucgacgagaaaguggacagagaggccagcgccaacacguucauccagcgcaugaagaccaccgacaccuaccugaucgaugaggacguucucccgaagcagucccugcuguaccaaaaguacgaggugcucaacgaacugaacaacguccggaucaauaacgaggcccugagcacggaccagaaacagcgccucauccacgaggucuucgagcgacacuccagcgugacgaucaaacaggugguggacaaucugguggcccacggcgacuuugcgcagcgcccugagauccggggccuggccgacgagaagcgauucuugucgagccuauccacguaccaccagcugaaggagauccuccacggggccaucgacgauagcacgaagcugcacgacaucgagaacaucaucacgugguccaccgucuucgaggaugccgccauauucaaaaccaagcuggcugagaucgauuggcucgacccggccaccaucaagaagcugucuaacauccgguaucgcggcugggggcaauucucccggaagcuacucgacggccugaaguuagggaacggccauaccgugauacaggagcucauguugagcaaccacaaccugaugcagauccucgccgacgagacgcugaaggagaccaugaccgagcugaaucaggacaaacuaaagaccgacgauaucgaagacgugaucaacgacgccuacacuuccccgucgaacaagaaggcgcugcgccaaguccugcgcgugguggaggauaucaagcacgccgccaauggccaggaccccuccuggcucuacaucgagaccgccgacgggaccggcaccgccgggaagcggacgcagucaagacaaaagcaaauucagaccguuuacgcgaacgccgcccaggaacugauagacagcgccgugcgcggggagcuggaagacaagaucgccgacaaggcguccuucaccgaccggcucgugcuguacuucaugcagggcgggcgcgacaucuacaccggcgcgccccugaacauagaccagcugagccacuacgacaucgaccacauuuugccccagucccugaucaaggacgacucauuggauaaccgcguccuggugaacgccacaauuaaccgggagaagaacaauguauuugccuccacccuguucgccagcaagauggccgccaccuggcgcaaauggcacgaggccgggcucaucagcggccggaaacugcgcaaccugaugcuccggccggacgagaccgacaaguucgcccacggguucguagcgcgccagcuuguggagacgcggcaaaucaucaagcugacggagcaaaucgccgccgcccaguaccccaacaccaagaucaucgccguuaaggccggucucagccaccagcugcgcgaggagcuggacuuccccaaaaaccgggaugucaaccacuaucaccaugccuuugaugccuuccucgccgcccgcaucggcaccuaucugcucaagcgguacccgaaacucgcacccuucuucacguacggggaauuugcaaaaguggacgugaagaaguuccgcgaguucaacuucaucggcgcccugacgcacgccaagaagaacaucaucgccaaggacaccggggagaucguuugggacaaggagcgggacauccaggaacuggaccgcaucuacaacuucaagcggaugcucaucacccacgagguucacuucgagaccgcagaccuguucgaccagacuaucuacgccgccaaggacuccaaggagcgcggcggaaggaugagccugauacccaagaaacucggcuaccugaccggcaucuacgggggcuaccaaacggagcggggguccuacgugaguauuauucgcacguucaagaagggagagaccaucuacaaggucgugaacauccugaccgccgacgugucccuccugagcgagaaggagaaggucucuaagacccuggccgacauuuaccucaaggagcuuaucgcgaagaagcugagcaaggggaagucaggcaagaauaucgccagcgagcccuucgagaucgugcucccgcgggugggcaaggacagccuguucaagaacaagaaguacggacuguuuuugaucgaguccgccacugagcugcacaacuaccaggagcuguggcucccccgcaacgaccagcugcugaucaagcggauccaggcccgccagaucgaggagucaaaggcggacuaugagcucacacggauguaccgcaacaucgcauggcagguagaucacuauuucagacuguacaaaauacgcaaguucgccgagaagcugcaggccagcgucgaggacuucgcuggccucccaguguacaagaacgagaccucagacgggaagguagaggugcuggcguccgugcugaagcggcucaacggcgccgccgacaaggggcgcaccaaccccacgaccgucaagcugcagucagacuucggccggaccuugcucaccaauggcaucgugcuggaagacgacuccagcaucguguaccaguccccgaccgggcuguuuaagcgcagcguuaagcucguggaccuguga

SEQ ID NO: 7727 - RNA, 4098 nt, Artificial Sequence
  Cas9 variant
augacuaaggaguacuaccuuggccucgacguggggaccaacagcgucggcugggccgugacggacucccaguacaaccugugcaaguucaagaagaaggacaugugggggauccgccuguucgagagcgccaacaccgccaaggaucggcgccugcagcggggcaaccgccggcgccuagagcggaagaagcagcgcauagaccugcuccaggaaaucuucucccccgaaaucugcaagaucgacccgaccuucuucauccggcugaacgagagccgccugcaccucgaggacaagucaaacgacuucaaguacccccuauucaucgagaaggacuacagcgacaucgaguacuacaaggaguuccccacaaucuuccaccuccggaagcaccucaucgaguccgaggagaagcaggacauccgccugaucuaccuggcccuccacaacaucaucaagacacggggacacuuucugauugacggcgaccugcagagcgccaagcagcuccgccccauccuggacaccuuccugcucuccuugcaagaggagcagaaccugucggugucccucagcgagaaucagaaggacgaguacgaggagauccugaagaaucgguccaucgccaagagcgaaaaggucaagaagcugaagaaccucuucgagaucuccgacgagcuggagaaggaggagaagaaggcccagagcgcggucauagaaaacuucugcaaauucaucgugggcaacaaaggggacgucugcaaguuccugcgcguguccaaagaagaguuggagauugacagcuucuccuucuccgagggaaaguacgaggacgauaucgugaagaaucuggaggagaaggucccagagaaaguguaccuuuucgagcaaaugaaggccauguacgacuggaacauacugguggacauccuggagacagaagaguacaucagcuucgccaagguaaagcaguacgagaagcacaaaaccaaccugcggcuccugcgcgacaucauccugaaguacugcacgaaggacgaguacaaccgcauguucaacgacgagaaggaggccggguccuacaccgcguacguggggaaguuaaagaagaacaacaagaaguauuggauugagaagaaaaggaaucccgaagaguucuacaagagccuggggaagcugcucgacaagaucgaaccccugaaggaggaccuggaggugcuaacaaugaugaucgaggagugcaagaaccacacccugcuccccauccagaagaacaaggacaacggcgucaucccgcaccaggugcacgagguggagcucaagaagauccuggagaaugccaagaaguacuacuccuuccugacggagaccgacaaggacggcuacuccgucgugcagaagaucgaguccaucuuccgguuccgcauccccuacuacguggggccccugagcacccgccaccaggagaagggcuccaacgucuggauggugcggaagcccggaagggaggaccggaucuacccguggaacauggaggagaucaucgacuucgagaagucuaacgagaacuuuaucacccgcaugacgaacaagugcaccuaccucaucggcgaggacguguugcccaagcacagccugcucuacagcaaguacaugguccuaaaugagcugaacaacgugaagguacguggcaagaagcuccccaccucccugaagcagaagguguucgaggaccuguucgagaacaagagcaaggugaccgggaagaaccuccuggaguaccugcagauccaggacaaggacauccagaucgacgaccucuccggcuucgacaaggacuucaagacgucccugaaguccuaccuggacuucaagaaacagaucuucggggaggaaauagagaaggagagcauacagaacaugauagaggacaucaucaaguggaucaccaucuacggcaaugacaaggagaugcucaagcgcgucauccgggccaacuacuccaaccagcugaccgaggaacagaugaaaaagaucaccggguuccaguacagcggcuggggcaauuucuccaagauguuccugaaggggaucagcggcagcgacguguccacaggggagaccuucgacaucaucaccgccaugugggagaccgacaacaaucucaugcagauccugagcaagaaguucacauucauggacaacguggaggauuucaacuccggcaaggucgggaagaucgauaagaucaccuacgacagcaccgugaaggaaauguuccugucccccgagaacaagcgcgccguguggcagaccauccaggucgcggaggagaucaagaaggugaugggaugcgagccgaagaagaucuucaucgagauggcccggggcggggagaaggugaagaagcgcaccaagucacggaaggcccagcuccuggagcucuacgccgccugcgaggaggacugccgcgagcucaucaaggagaucgaggaccgggacgaacgcgacuucaacuccaugaagcuguuccuguacuacacgcaguucggcaagugcauguacucaggggacgacaucgacaucaacgagcucauccggggcaacuccaagugggaccgcgaccacaucuacccccagagcaagaucaaggaugacuccaucgacaaccugguccuggugaacaagaccuacaacgcgaagaaguccaacgagcuccugucggaggacauccagaagaagaugcacaguuucuggcugucccuccugaacaagaagcugaucaccaagagcaaguacgaccgguuaacgcggaagggggacuucaccgacgaggagcugucuggcuucaucgcccggcagcugguggagacccgccagagcaccaaagccaucgccgacauauucaagcagaucuacagcuccgagguaguauacgucaagagcucccucgucagcgacuuccgcaagaagcccuuaaauuaccugaagucgcggcgcgugaacgacuaccaccacgccaaggacgcguaccucaacaucgugguaggcaacguguacaacaagaaguucacuagcaaccccauccaguggaugaagaagaaccgggacacgaacuacucccugaacaagguguucgagcacgacgucgugaucaacggggagguuaucugggagaagugcaccuaccacgaggacaccaacaccuacgacggcgggacacuggaccgcauccggaagaucgucgagcgcgacaacauccucuacaccgaguacgccuacugcgagaagggcgagcuguucaaugccaccauccagaacaagaacgguaacagcaccgugucccugaaaaagggauuagacgucaagaaguacggcggcuacuuuagcgccaacacguccuacuucagccugaucgaguucgaggacaagaagggcgaccgggcccgacacaucaucggggucccgaucuacaucgcgaacauguuggagcauucccccagcgccuuccucgaguacugcgagcagaaaggauaccagaacgugcggauccugguggagaagaucaaaaagaacucccugcucaucaucaacggcuacccccugcgcauccgcggcgagaacgaagucgacaccagcuucaagcgggcgauccagcugaagcucgaucagaagaacuacgaacuggugcggaacaucgaaaaguuccuggagaaauauguggagaagaaaggcaacuaccccaucgacgagaaccgcgaccacaucacccacgaaaagaugaaccagcucuacgagguccuccuguccaagaugaagaaguucaacaagaaggggauggccgauccgagcgacagaaucgaaaaguccaagcccaaguucaucaagcucgaggaccugaucgacaagaucaacgugaucaacaagaugcugaaccuccugcgcugcgacaacgacaccaaggcggaccugagccucauugagcugcccaagaacgccggcagcuucguggucaaaaagaacacgauugggaaguccaagaucauccuggugaaccaaucugugaccggccucuacgagaaccggagggagcuguga

SEQ ID NO: 7728 - RNA, 4098 nt, Artificial Sequence; identical to SEQ ID NO: 1928
  Cas9 variant

SEQ ID NO: 7729 - RNA, 4098 nt, Artificial Sequence
  Cas9 variant
auggugaagaagaaguacgcuauaggcaucgacauagggaccaacagcgucggguggucgguggugaccgacgacuacaagguccccagcaagaagaugaagguguucgggaacacggagaagcgcuacaucaagaagaaccugcucggcaccuuacuguucgacgaggggaauaccgcggagaaccggcgccucaagcggaccgcgcgccggcgcuacacgcggcgccgcaaccgcauccuguaccugcaggagaucuucgcagaggagaucaacaagaucgacgacuccuucuuccagcggcucgacgauagcuuccugaucguggaggacaagcagggcuccaagcacccuaucuucggcacccugcaggaggagaagaaauaccacaaacaguuccccaccaucuaccaccuccgcaagcagcuagccgacagcucccagaaggcugacauccggcugaucuaccucgcccuugcgcacaucaucaaguaccgcgggcacuuccuguucgagggcgaccucaagagcgaaaacaaggauguccagcaccuguucaacgacuucguggagauguucgacaagaccguggagggguccuaccugagcgagaaccuccccaacgucgccgacguacugguggagaaggucuccaagagccggcgcuuagagaacauccuccacuacuuccccaacgagaagaagaacggccuguucgggaacuuccuggcccucgcccuugggcugcagcccaacuucaagacgaacuucgagcucgccgaggacgccaagauccaguucuccaaggaaaccuacgaagaagaccuggaggagcugcucggcaagaucggggacgacuacgccgaccuguucaucgcaaccaagagccuguacgacggcauccuccuggccgggauccuguccaccacggacagcaccaccaaagcgccccucuccagcuccauggugaaccgguacgaggaacacaagaaggaccuggcucugcucaagaacuucauccaccagaaccugagcgacagcuacaaggagguguucaacgacaaacugaaggacggcuacgccggcuacaucgagggcaagaccacgcaggagaacuucuaucgcuucaucaagaaggcaaucgaaaagaucgaaggcuccgacuacuucaucgauaaaaucgaccgggaggacuuccuccgcaagcagcggaccuucgacaacgggagcauuccccaccagauacaccuccaggagaugcacgccaucauccgacgccaggcggaguucuaccccuuccuggucgagaaccaggacaaaaucgagaagauccucaccuuccggaucccguacuacgugggcccauuggcccgcggcaaguccgaguucgccuggcugaaccgcaagagugacgagaagauccggcccuggaacuuugaugagaugguggacaaggagaccuccgccgagaacuucaucacgcggaugaccaacuacgaccaguaccuccccgaccagaagguccugccgaaacacagccugcuguacgagaaguucgccgucuacaacgagcucaccaaggugaaguucaucgcggaaggcaugcgcgacuaccaguuccuggacuccggacagaagaaggacaucgucaagacgcuguucaagacgaagcggaaggugaccgcaaaggacaucaaggccuaccucgagaacagcaacggguacgccggcguggagcuaaaggggcuggaggagcaguucaacgcuucacuccccacuuaccacgaccugcugaagauccuccgcgacaaggcguucaucgacgccgaggagaaccaggagauccuggaggacaucguccugacccugacguuauucgaggaccgggagaugauacgcaagcggcuggaaaaguacaaggauauccugaccgaggagcagcgaaagaagcuggagaggcgccacuacaccggcugggggcggcuaucggccaaacuuauaaacggcauuuuagacaaggugacccgcaagacgauccucggcuaccucaucgacgacgggaccuccaacagaaacuucaugcagcugaucaacgacgacacccugagcuuugucgacgagauccgcuuagcccagggcuccggggaggcggaggacuaccgggcagaggugcagaaccuggccggcagccccgccaucaagaaggggauccugcagucccucaagaucguggaugagcugaucgagguuaugggcuacgaccccgagcacaucgucguggagauggcaagggagaaccaguucaccaaucaaggucgccggaacagccagcagcgcuacaaaaagaucgagaacgcgaucaagaaccuagacuccaaccucaacagcaagauccugaaggaguauccuacgaacaaccaggcacuucagaacgaccggcuguucuuguacuaccuucagaacgggaaggacauguacaccgacgaggaacucgacaucgaccagcuuucccaguacgauaucgaccacaucaucccccaggccuucaucaaggacgacagccuggauaauaagguccugaccaagucggcaaagaaccgcggcaaguccgaugacgugcccagccuggagaucgugcauaagaagaagaacuucuggaagcagcugcucgacucccagcugaucucccagcggaaguucgacaaccugaccaaagccgaacgcggaggccucaccaacgaggacaaagcgcgguucauccagcgccagcuggucgagacgcggcagaucaccaagcacguggcccgcauccuggacacccgguucaacaccaagcucgacgaggcaggcaaccgcaucagggaucccaagguaaacaucaucacgcuaaagagcaacuuggucagccaguuccgcaaggacuaccagcucuauaaggugcgggagaucaacaacuaccaccacgcccacgaugcguacuugaacgcgguggucgccaccgcccuacucaagaaguacccgcaacuggcccccgaguucguguacggggacuaccccaaguacaacuccuacaagagccgcaaguccgcgaccgagaaggugcuguucuacagcaacaucaugaacuuuuuccggcgcguccucguguacagcaagaccggcgaggugcggauccgcccagucaucgaggugaacaaggagacgggggagaucgugugggacaagaaguccgacuuccgaaccgucagaaaggugcugagcuacccccagguaaaugucgugaagaagguggagaugcagaccggcggguucagcaaggaguccauccugcagcauggcgacagcgacaagcucaucccccggaagaccgagaaguucuaccuggacacgaagaaauacggcggguuugacucccccaccaucgccuacagcguccugcucaucgccgacaucgaaaagggaaaggccaagaagcugaagcgggugaaggagcugaucgggaucaccaucauggagcgcauggccuucgagaagaaccccauugaguuccucgagcacaaaggcuacaagaacauccuugagaagaacaucaucaagcugccgaaguauagccucuucgagcuggagaacgggcgccggcggcugcucgcguccgcuaaggagcugcagaaggguaacgagaugauccugccgccccaccucgugacccugcuguaccacagcuccaacauccacaagaucacugaaccgauccaccucaacuacgucaacaagaacaagcacgaguucaaggagcugcugcgccacaucagcgacuuuuccacccgguacauccucgcccaggaccgccugagcaagaucgaggagcuguacgacaagaacgacggcgacgacaucuccgaccucaccagcuccuucgugaaucugcugaccuucacggccaucggggcccccgcggccuucaaguuccucggaagcgugaucgaucguaagcgcuacaccuccaucgccgagauccucgaggcaacccugauccaccagagcgucaccggccucuacgagacgcggaucgacuuauccaagcugggcggggacuga

SEQ ID NO: 7730 - RNA, 4101 nt, Artificial Sequence; identical to SEQ ID NO: 1930
  Cas9 variant

SEQ ID NO: 7731 - RNA, 4101 nt, Artificial Sequence
  Cas9 variant
auggacaagaaguacaacaucggccuggacaucgggaccagcuccaucggcuucguggccacugacgaggacaaucacgucauccgcgccaaggggaagaacgugaucggcgugcggcuguucgacgaggggcagagcgcggccgagcgccggggcuuccgcacgacccggcgccggcugaaccgccgcaaguggcgccugaaccuccugcgggagaucuucgagccccacaucuacccgaucgacgccuccuucuucaugcggcagaaguauagcaaccugucuaagcaggaccccaaccagaagaucgaguucaaggacauccucuucagcgacaaguccgacgccgaguucuaccggcaguaccccaccaucuaccaccuccgccaggcccugaugaccgagaagcggcaguucgaccuccgcgagaucuaccuggcgauccaucacaucgucaaguaccggggccacuuccuggacgaaacgcccaccgacaaguucagcuucgaccaacucgaccugacccaggaguucgagcgacugaacguccucuucuccgagcagaacccagaggagcccuucgagaucguggugaaccagaaccagagcaucgaggacauccuguccaaccagagcaugaccgccuccgaccggcgcaagcaggcccuggugguguucuaccagcagucggagaacaaggagaacgagaagcaguacaaggccaucgcuacggagauccucaaccuccugcucgggaacaaggccaagcugaacguaauccuggcccaggagguggacaaggaggccgccaaggacuggucccucagccuauccagcgagaccuucgacgacgaccuggagaaggcguccagcggccucaacgacagccagcuggagaugguggggaucuucgagcggaucuacuccagccugauccucaaguccaucaucggcgaccacaacagcuuauccgccgccauggucgacaaguuuaagacccacgcccagcaccgcgaccugcucaaggacgugaucaagaacagcgacgccaccaagggggagcagcugcaguucgcguacgaccacuaccugcaacgccacuccgccgacggcaaggccuacggcaaagacgacuucuacaaggaagucaagaagaaccucgacgauagcgacgccgcccagcagauccagcaacucaucgacacggaccaguucaugcccaagcaacggaccaaggcgaacggggcgaucccccaccagguccagcagaaggagcuggaccucaucaucgagaaucaaugccaguacuacccguggcuggccgaggagaaccccaacuccgagcgccacaacguggccaaguacaagcuggacgaguugguguccuuccggguccccuacuacgugggcccccugaucuccccggccgacgacgagaccgauccccaggcgauccagaacaccaaguucgccuggaugauccgcaaggacgcccaggggcggauuacgcccuggaacuucgacgacaagguggaccgcgagaaguccgccgacaaguucaucaagcggaugaccaccaccgacacguaccugaucggcgaggacguccuccccgaccagagccugaucuaccagcgcuacaaggugcugaacgagcucaacaacgugcggaucaacggccgcccgaucgagguccagaucaagcagaacaucuacaccgaccucuucaagaaguucaagagcguguccgucaagaagcugcggagcuaccuggaggagauguccuacuaccccgggagcuucaagaucuccggccuaaccaaccccgggaaguucgacaacggccugaccagcuaccuggacuauaagaacauccucggggacagcguggacgcgaacgacaagcgcgccgacaucgagcagaugaucgagugguccacgaucuucgaggacaacaagaucuucgcccagaagcuggaguccaugaccuggcugaccgccgagcagcggaaggccaucucccgcaagcgguacaccggcuggggccgccucagcaacaagcugcugacgcagcucaaaaaccaggacaaccgguccaucauggaccugcugugggagaccgaggagaacuucaugaagauccagagcgcgcccgacuucuccaaaaugaucgaggcacacaaccagcaguucaucaagaacgaggccaacauccaacaggucaucagcgaccucuacaccuccccgcagaacaagaaagccauccgccaaauacugcuggugguggacgacauccagaaggccguugggcacgcgcccgagcacauagccaucgaguucgccaagggcgaggacaagaacccgcggcgcaccaucagccgcgagaugaagauccaggacgucuaccagcagaucuccgacgacauccucgugagccccgaggugcgggcccagcugaacgagaaaaucgagaaccgccacgggcggcuguccgaccgccucuuccuguacuucaugcagggcgggcgggacauguacacgggcaagccgaucaacaucaacaacaucagccacuaugacaucgaccacauucugccccaggccuucaucaaggacgacucccucgacaaccgcguccuggugagcgacaagcugaaccgggagaaguccgacaccgugccccgcgaccucuucggccgggagaugaugagcaccugggagaagauggcggaccgcgggcugaucaccaagcggaagcuggccaaccucaagacgauccccggcagcaucgacgcccacaaggcccagggguuuaucaaccgccagcuuguagagacccgccaggugaucaagcuggcggucggcaucaugaucgaccaguacccggagacccagaucguguccgugaaggccaaccucacccacgagaugcgggaaauguucgacuuagugaagaaccgggacgucaacgacuaccaccacgccuucgacgccuaccugacagccuucguggggaacuaccuccugcaacgcuaccccaagcuggagcccuacuucguuuacgacaaguucaagaagcucaaggaucagaacaucagcaugcgggacuucaaccugcuguacgaccucaagaagaacgaggacgucuacgaccagcgcacgggccacuccgcgcacaagaucugggaccagcacggcagcauagacuacauccggcaccuguucgccuauaagaagauccuggugucccacgaggugcaccagaacgguggcgcccucuacaacaugaccgucuacgggaaggccgacgacgccaagcgcaagcugaucccgauaaaggcggacaagcccaccgagcuguacggcggguacaccagccggaagcucgccuacauggcuaucgugaagacgaaaaaggggaagaaggagcaguaccaggugaccggcguccccguguccgcccugaccacccugcgccaguucaaggaggacagccccgagcagaagcaggcccucgaggagauugugcgccggaacuucgacgagaagacggaggucgagaucaucgugccgaaggugcuguucaaccagcugaucgucgacgagaaaugccgcuucauggugggguccgacaccuaccgguacaacgcgcagcagcucgugcugagcgcggacgaccuggagaucaucaacgccucccacaaggacauccagaccaucgacagcuccgacuacagccagcagcucgaccaggucuaccagaacauccugacgauuguggacaagcacuuccccauguacgacaucaacaaguuccgcacgaagcuccacgacaucuacgagcaguacaucgagcuccccaacgaggacgugugggagaacaacaagcugacgacccugggcaagcacaccaucaucauccggauccuccaggggcugcacgccaacgcuacggucguggaccugaagcagcucggcaucaagacccccuucggcuucaugcagcaggcccgcgguauaguggucuccccggacgcccagcugaucuaucagucgcccaccggccuguacgagcggcgcgugcggcucggggaccuguga

SEQ ID NO: 7732 - RNA, 4101 nt, Artificial Sequence; identical to SEQ ID NO: 1932
  Cas9 variant

SEQ ID NO: 7733 - RNA, 4101 nt, Artificial Sequence
  Cas9 variant
augaccaagcugggcaagcccuacggaaucgggguggacaucgguagcaacucgaucggcuucgccgccgucgacgagaacagccaucucauccgccugaaggggaagaccgugaucggcgcgcggcuguucgaggagggcaaggccgccgcguaccggcgugccucccgcacgacccggcgccggcuaagucgcaaccgguggaggcuguccuuccugagagauuucuuugagagccacauaaccccgaccgaccccaacuucuucaugcgccagaaguacucugagaucagcccaaaggacaaggcgcgguacaaguacgagaagaggcuguucaacgaucggacggacgccgaguucuaccagcaguacccaaccauguaccaccuccgaacccgacuccugacagacccguccaaggccgacgugcgcgagaucuacuucgcgauccaccacauccucaagagccgggggcacuuccucacgccuggcuacgcgaaggacuucaacaccaauaaggucgcccugaacgagaucuuucccgcccuucaggaugccuacgcccagguguaccccgaucuggacauaaccuucgacgagaacaaggugaacgaguuuaagaccgucuugcugaaugagaaggcgacgcccagcgacacucagcgcgcccuggugaaccuccugcuggccaaggagggggaccgggacauccucaagcagcagaagcagguccugaccgaguuugcuaaggccgucgugggccuaaagaccaagcucaacguggcgcuggggacggaggucgacagcuccgaggccaccgccuggaauuucagccugggccagcuagacgacaagugggccggaauagaguccgccaugaccgaugaggggaccgagauccucgaccagaucagggaccuguaccgagcgcggcuccugaacgggaucgugcccgccgggaagacacucagccaggccaagguggacgacuacgcccagcaccacgaggaccucgagcuguucaaggauuaucugaagcaacucgaggaugacggcaccgcuaaggcuauacgccagcuguacgaccgguauaucgacggcgacgaugccaagcccuucgucagggaagacuucgugaaggcacuaaccaaggaggugaccgcccaccccaacgcgaagaguccggagcuccuggagcgccuggcccagcccgacuucaugcucaagcaacgcaacaaagccaacggggccauccccguccagaugcagcaacgggagcuggaccagauaaucaagaaccaggcgguguacuacgauuggcuggcggcccccaacccgguggagaagcaccgccagagcaugacguaccagcucgaugagcugcugaacuuccggauccccuauuacgucggccccuuggugaccgccaaggagcaaaaggccgcccagggcggggucuuugcguggaugguccgcaaggaccccgacgggaacaucaccccuuauaauuucgacgagaagguggaccgggaggccuccgcuaacacguucauccagagaaugaagacgaccgacaccuaccugaucggggaagacguccugccaaagcagagcuuacucuaccagagcuacgaggugcugaacgagcugaacaacgugagagucaacgacaacaagcucuccuucgaucaaaagcagcagguccugggcgaauuauucgagcgccacaacaccgugacgaucaagcaguucguagacaaccuccuggcgcacggggacuacgaccggauccccgaggugcgagggcuggccgacgaaaagcgguuccucagcucucugagcaccuacaaccagcugaaggggauccuccacgaggcgaucgaugacgccgacaagcagaccgacaucgaaaauauaaucgccuggucgacuauauucgaggacaaggcaaucuucaaaacgaagcugaacgaaaucucuuggcugaacgcgggcaugaucaacagccuggcgaacauccgcuaccggggcuggggccaguucagccacaaauuacugaacgaacucacccuguccacgggucgcaccguguucgaggagcugcuaaucagcuccaggaaccugaugcagauccugaccgacgagguccucaagcagaagauugccgagcuaaacgcccaugaacuuaaggccucugggaucuacgcggccaucgacgacgccuacacgucccccagcaacaagaaggcacuucgccaggugcugagugugauugacgacaucacaaacgccgcgggccaggcccccaacuggcuguacaucgagaccgccgacggggacggcgucccggggaagcggaccaacagccggcagcgcaagauccaggagaucuacgccaaugccgcacaagagcucauuacgggcuccgugcgcggcgaguucgaggacaagaucgccagccgcgcugauuucaccgaucggcuggugcuguacuucaugcagggugggcgugacaucuacaccggggagccccucaauaucgacaaccuaucgaguuacgacaucgaccacauccugccccaaagccucaucaaagacaacucccuggacaaccggguccuggugcacccgcucgucaaccgcgagaaggacacaaucuucgccagcacccgguucgcgaagcagaugaauggcauguggcgccaguggcacgccgccggccugaucuccagccggaagcugcgcaaccuccagaugaggcccgacgagaucgauaaguaugccucgggguucgucgcccgccagcugguggagacacggcaaaucauuaagcugaccgagcagaucguggcggaccaguaccccgauaccaagauuaucgcggucaaggccggacucagcucccaguugcgcaaggagcuggacuucccgaagaaucgggaggugaaccacuaccaccacgccuucgacgccuuccuagcggcucgcaucgguacauaccugcugaaacgguacccaaaccucgagcccuucuucaccuacggcaaguucaagaagaccgaagugaagaaguuaaagagccugaagucccucaagagcuucaacuucauccgcgacaugacccacgccaaagacaaaaucgucgcgaaggagacgggggagaucguaugggacaacgcuuccgacaucaacgagcuagacaggaucuauaacuucaaacggaugcugaucacccacgaggugcgcuucgagaccgcgagccuguucaagcaaacccuguacgcagccaagaacagcaagaaucggggcggcagccgccagcugauccccaagaagaagggguaccucguagacaucuacgggggcuacacgcaggaaaccggcuccuaccugagcguagugcggcugaccaagaaggcaauguacgccgucgucaagguguccacccgugaugcggccaaguuagccguagcaaaguccaucagcgaacagaaggagaaugagacgcugaagaagaucaucgacgggaagcuguccaagacaagcaagaagggcaagaccacccaccagcuuuucgagaucgugcugccgcgggugggccagaagacgcuauucaagaacuccaaguacaaccaguuccucgucaacucugacaccuacaugcacaauuaccaagaacuguggaugccccgcgaguaccagagaauguggaaggacauccugcucuccaaccacggggacgcgcagauugagggccagcuggaucagaucuucaaguucauugucagccaagugaacuccuacuucaaccuguacgacaucaaccaguuucgcaagaagaucgccgacgccaccgacaaguucgccaagcuccccacccacgacacggacaacgcccgggggaagaucgcgaccaucggccagcugcugaucgggcuccaggccaacgccaugcgcagcgauuugcggaaccuagacaucaagacccccuucggccuccugcaaaucggcacggggaucacccuugaccucgacaccuccauaaucuaucagagcccgaccggccuguucgagcgcgagguaccccugaccgaccuauga

SEQ ID NO: 7734 - RNA, 4101 nt, Artificial Sequence
  Cas9 variant
augaccaaggacuacagccugggccucgacauugggaccggcuccgugggguucgccgcccuggacacgaacuaccgccugcuccgggcgaagggcaacaacgucaucgggguccgccuguucacccccgccgagaccgccgaggagcgucgcggcuuccggaccgcccgccggcgccugagccggcgucgguggcgccucggcgcccugaacgggaucuuugcgccggagcuggccaagguggaccccaacuuccuccaccggcugaaguacgccuggguccaccccgccgaccagcagaacaagggcaaguacuccgcggcgcccuuauucaacgacgccgcccucgaccgccaauuccacgacgacuacccgacgaucuaccaccuccggcugaagcugaugacggacaccagccagcacgaccugcgcgagguguaccuggcaauccaccacaucaucaaguuucgggggaacuuccuccgcggcgaggggccuaucaacgccuccgaggccuucgacauaaacaccuucaucgaccagaugacggccuucuacgaccaggccuuccccgacuucaagaucguggaccaggucgaccagcagaucaucuucaagggccugaccgacaugacccugagccccgccgaccgggcgaacaaggcuuuaaugggcuucaacaacgccgcccagcagccgaacaagcgcaucuucaaggccauccuguccggucuggugggaaaccagguggaccucauggcgaucuuccaacuggacgggauccccaaggaggaccagaaggaauuuaaguucaaguucgucgacaacgacaucgaggagaagcuggccgcccucggcgacaaccccgcccugagcgacgagcagaacgaguuccugaccacgcucuaugccgcguucuccggccugacccugaaggggcuccugggagacgccaccagcaucagugccgccaugguggcccgguacgcuagccaccgcaccgacuggacguacaucaaggaccacgugcugacgccccagaacaaucgcgagcuccggcuggccuacgccgaccugaugacugacaacgaggacguccgacucaaagccgggaagaaguucgcgaaggccaucgaggccgccgacauacccgccgcgaagaaguccgaguucagccugaagaucgacaacaacgaguuccugccccggcagcgcaccaaggccaauggcaccaucccccaccagcuccaccugaacgagcugcagcagaucaucgagaaccaggggcaguacuaccccuuccucaaggccaccuucgagcaggacggccacacccuaaacaagaucgagggccuggugaaguuccgggugccguacuacgucgggccccuagugcccaagcacaagguggccggaaacaaugccaaucacuggaugguccccaaggaaccgggggcgaucacccccuggaacuauacggagaagguggaccgcgacaaguccggcaacgaguucauccggcgcaugaccgggaccgacaccuaccugcugggcgaacccacgcugcccaagaacagcuuaguguaccaggaguucaacguccugcaggagcugaacaaccuccggaucgagaagcgccggcuggacaucgccgugaagcaggacaucuucgagcacguguucaagaccaacaagaccgucaccgugaagcgcaucgaggaguaccugacgaccgaguucggcuccccggucacccucagcggguucgccaacgugaacgagcggaagcugaacuccagccugagcaccuaccacuacuucgugggcaucuucggggccgaguucgucgacgaucccaaaaaucucacguugcuggagcagaucguggagcuccaaaccguauucgaggaccgcaaggcgcugcagcggcaguugaagcuccgccccgagcuguccgagaagcaggucaagcagcuggcccggacccacuacaccggcugggggcgccucagccaaaagcugcugaccuccaagaucgugcacguggcccucgagggcgagcgggagcccggccaguacucgauccuggagacgcuguacgggacccagaugaacuucauggagaucgucaacgacaugaaggaccgcuacggcgugaaguccuggcucgaccaggagaacagcggguccgagaacaaccuaagccugaagcagcgcauccucgacaugccgggccccaagaacaucaagcggggcaucaaccaggccuuccacaucaucgacgagaucacccgcgccguggggaacgcucccucccgaaucuacaucgaguucgcccgcgagagccagcaguccaaccugaccaacgcccgggucaaccgccugaagcagcucuacagcaaccaggcccugaagaaagaguucgccaagcuggcguccgagaucaaggaccucaccaaggaacagcugaaggacgaccggcuguaccucuacuaccugcaacagggcaaggacauguacacggagaccgacaucgacaucaccaagauuagcuccaacuaccagaucgaccacaucaucccgcaggccuacacaaagaacaacagccuggacaaccgcgugcucgugaacucggagaugaacgcccgcaagagcgacucccccacguuccuacccagccugauccaggagcggaaggccugguggcggcagcuccgcgacaccgggcugaugagcaccaucaaguacaacaaccugacgcggaccuccgacgacuucagcgccgaccaaaaggagcgcuucaucgcgcggucccucguagagacccgccaggugaucaagaacguggccacccugaucaaggaguacuaugacgauagccaggucgaggcccugcccuccgagaucacggccgagaugcggcgcuaccucaacgugcggaagaaccgcgacaucaacgacuaucaccacgcgcaugaugcccugcuguucgccaccgccggcgaguucagccggaagguggggaucauggagaagggccgcgucuccgacggcgccgggaacauuuacaaccgcuacaccaaggacaucauccagcgggcgcgcgccaaggccggccaggacaagaaggugcggccguucaccuucaucguggggagcauggccaaccccgacacgaaguuccagacaaaccagaccaccggcgagaucgucuggacgcccgaggacguggccuaucuccgcaaggugaucgacuacaagaagaugcuggucaccaagaugacccuggaccaaaccgggacgcucuacaacgagacccguuacggcuccggcgacaagcacguggcgguggcccugagcaaggacaaggccgccgaccuguacgggggcuucgggucccuaaagcccgccuacgcggcccuggucuauagcaagaagaaguuccgccuggugaacgugcuccggcuguggcugccggagaucaagaagaacgccuccguccucgagcgcaaggugcagagcgugcugggcgacgacaacgccaaggucauccgggcccacgugcccugcgggcagcugcucaucaaggacggcgcacuggugaccgucuccagcgcgaccgagcugcacaacuucagacaacucuggcugccuaaggccgacuaccaagacaucuccauccugcucggcgcccccgacaaggugacggcggagaaccggcugcaggccgagagccacuucgacgacguggaccagcgcuucgagagccugcugaaggacgucaucgaccaagcccggcaguacuauccgcugaagacccaccagaccucccuggagaagcucaucgggaagaucggcaaguucgacgagcugaaguucgcccagaagcagcaggucuucagccgccugcucuccgcccugcaugcgaacgccaccaacagcgaccugaagcagaucggacucuccacggccuggggccggcugaucuaccccaaggggguaagccugaccgaugaggacaagcucaucaacuccagcuucaccggccuguucaacgacgugauguccauaaaggaguuccacgacuucagcaucaacuga

SEQ ID NO: 7735 - RNA, 4104 nt, Artificial Sequence; identical to SEQ ID NO: 1935
  Cas9 variant

SEQ ID NO: 7736 - RNA, 4104 nt, Artificial Sequence; identical to SEQ ID NO: 1936
  Cas9 variant

SEQ ID NO: 7737 - RNA, 4104 nt, Artificial Sequence; identical to SEQ ID NO: 1937
  Cas9 variant

SEQ ID NO: 7738 - RNA, 4104 nt, Artificial Sequence; identical to SEQ ID NO: 1938
  Cas9 variant

SEQ ID NO: 7739 - RNA, 4104 nt, Artificial Sequence; identical to SEQ ID NO: 1939
  Cas9 variant

SEQ ID NO: 7740 - RNA, 4104 nt, Artificial Sequence; identical to SEQ ID NO: 1940
  Cas9 variant

SEQ ID NO: 7741 - RNA, 4104 nt, Artificial Sequence
  Cas9 variant
auggugaagaagaaguacgccauuggcaucgacaucgggaccaacagcgucggcugguccguggugaccgacgacuacaagguccccagcaagaagaugaagguguucgggaacacggagaagcgcuacaucaagaagaaccugcugggcacccuccuguucgaugaggggaacaccgccgagaaccggcgcuuaaagcggaccgcgcgacggcgcuacacgcggcgcagaaaccgcauccuguaccugcaggagauauucgccgaggagaucaacaagaucgacgacuccuucuuccagcgguuggacgacagcuuccugaucguggaggacaagcagggcuccaaacacccgaucuucggcacccuacaggaggagaaggaguaccacaagcaguuccccaccaucuaccaccuccgcaaacagcuggccgacagcucccagaaggccgacauccgccugaucuaccucgcccuggcgcacaucaucaaguaccgcgggcacuuucuguucgagggcgaccucaagagcgagaacaaggacguccagcaccuguucaacgacuucguggagauguucgacaagaccguggagggauccuaucugagcgagaaccuccccaacgucgccgacgugcugguggagaaggucuccaagucacggcgccuggagaacauccuccacuacuuccccaacgagaagaaaaacggccuguucgggaacuuccugacgcucgcccugggccugcagccgaacuucaagaccaacuucgagcucgccgaggaugcgaagauccaguucuccaaggagacauacgaggaggaccuggaggagcugcucggcaagaucggcgacgacuacgccgaccucuucaucgccaccaagagccuguacgacggcauccuccuggccgggauccuguccacgaccgacagcaccaccaaggcgccccucuccagcucuauggugaaucgguacgaggagcaccagaaggaucuggcccugcucaagaacuucauccaccagaaccugagcgacagcuacaaggagguguucaacgauaagcugaaggacggcuacgccggcuacaucgagggcaagacgacccaggagaacuucuaccgcuucaucaagaaggccaucgagaagaucgagggcuccaacuacuucaucgacaagaucgaccgggaggacuuccuccgcaagcagcggaccuucgacaacggaagcaucccccaccagauccaccuccaggaaaugcacgccaucauccgccgccaggccgaguucuaccccuuccuggucgaaaaccaggacaagaucgagaagauccucaccuucagaaucccguacuacgugggcccccuggcgcgugggaaguccgaguucgccuggcuuaaccgcaagagcgacgagaagauacggccauggaacuucgacgagaugguggacaaggagacguccgccgagaacuucaucacccggaugaccaauuacgaccaguaccuccccgaccagaaggucuuaccgaagcacagccugcuguacgagaaguucgccguguacaacgagcucaccaaggugcgcuacgucacggagcagggcaagagcuucuucuucgacgccaacaugaagcaggagaucuucgacggcguguucaagguguaccggaaggucaccaaggaaaagcugauggacuuccuggggaaggaguucgacgaguuccgcaucguggaccuccugggccuggacaaggacaacaagagcuucaacgcgucccucgggacauaccacgaucugaaaaagaucgucagcaaggaccugcuugacaaccccgagaacgaggacauccuggagaacguggugcugacccucacgcuguucgaggaccgggagaugauccgaaagcggcuggagaaguacaaggauguccucacggaggaacagcgcaagaagcuggagcggcgccacuacacgggcugggggcggcuguccgccaaacucaucaacgguauccgcgacaaggugacccggaagacgauccuggacuaccugaucgacgacggcaccagcaaccgcaauuucaugcagcucaucaacgacgacacccuguccuucguggacgagauccggcuugcccaggggagcggcgaagccgaggacuaccgcgccgagguccagaaccucgcggggucccccgccaucaagaagggcauccugcagagccugaagaucguugacgagcucaucgaggugaugggguacgacccugagcauaucgucguggagauggcccgcgagaaccaguucaccaaccaggggcggcgcaacucccagcagcgguacaagaagaucgagaacgccaucaagaaccuggacagcaaucucaacuccaagauucucaaggaguacccgacgaacaaccaggcgcugcagaacgaccgccuguuccucuacuaccugcagaacggcaaggacauguacaccgacgaggagcuggacaucgaccagcucagccaguacgacaucgaccacaucaucccccaggccuucaucaaggacgacagccuggacaacaaggugcugaccaaguccgccaagaaccgggggaaguccgacgacguccccagccucgagaucgugcacaagaagaagaacuucuggaagcaacugcuggacagccagcucaucucccagcgcaaguucgacaaccugaccaaggccgagcguggagggcugaccaacgaggacaaggcccgcuucauccagagacagcucguggagacgcgccagaucaccaagcacgucgcgcggaucuuggacacccgguuuaauaccaagcuggacgaggccggcaaccggauccgcgaccccaaggugaacaucaucacgcucaagagcaaccuggugucccaguuccguaaggacuaccagcuguacaagguccgcgagaucaacaacuaccaccacgcccacgacgccuaucucaacgccgugguggcgaccgcccugcugaagaaguauccgcagcucgcccccgaguucgucuacggcgacuaccccaaguacaacagcuacaagucccgcaagagcgccaccgagaaggugcuguucuacuccaacaucaugaacuucuuccggcgggugcuggucuacagcaagaccggggaggugcgcauccggcccguuaucgaggucaacaaggagacgggcgagaucgugugggacaagaaguccgacuuccgcaccgugcgcaagguccucagcuacccccaggugaacguggucaagaagguugagaugcagaccgggggcuucuccaaggagagcauccugcagcacggggacuccgacaaacugaucccccggaagaccgagaaguucuaccucgacacgaagaaguacggcggcuucgacagccccaccaucgccuacagcgugcugcuuaucgcggacaucgagaaggggaaggccaagaagcucaagcgggucaaggagcugaucggcaucaccaucauggagcggauggccuucgagaagaaccccaucgaguuccuggagcacaagggguacaagaacaucuuggagaagaacaucaucaagcugccgaaguacucccuguucgaauuggagaacggccgccggcgccugcuugccagcgcgaaggagcuccagaaggggaacgagaugauccugccgccccacuuggugacccuccuguaccacuccagcaacauccacaagaucacggagccgauccaccugaacuacgugaacaagaacaagcacgaguucaaggagcuccugcggcacaucuccgauuucagcacccgcuacauccuggcccaggaccggcucuccaagaucgaggagcuguacgacaaaaacgacggcgacgacaucagcgaccugaccuccagcuucgucaaccuccugaccuucacggccaucggcgcgcccgccgcguucaaauuccugggguccgugaucgaccgcaagcgguacaccucgaucgccgagauacucgaggccacccugauccaccaguccgugaccggccuguacgagacacgcaucgaccucagcaagcucgggggcgacuga

SEQ ID NO: 7742 - RNA, 4104 nt, Artificial Sequence
  Cas9 variant
auggugaagaagaaguacgccaucggcaucgacaucgggaccaacagcgucgguugguccguggugaccgacgacuacaaggucccaagcaagaagaugaagguguucgggaacacggagaagcgcuacaucaagaagaaccugcugggcacccuguuguucgacgaggggaacaccgccgagaaccggcgccucaagcggaccgcgcgccggagauacacgcggcgccggaaccgcauccuuuaccugcaggagauuuuugccgaggaaaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggcugacauccggcugaucuaccucgcccuggcgcauaucaucaaguaccgcgggcacuuccuguucgagggcgaccucaagagcgagaacaaggacguccagcaccuguucaacgacuucguggagauguuugacaagacaguugagggguccuaccugagcgagaaccuccccaacguggccgacgugcugguggagaaagucuccaagagccggcgccuggaaaacauccuccacuacuuccccaacgagaagaagaacggccuuuucggcaacuuccuugcccucgcccugggccugcagccgaacuucaagacgaacuuugagcucgcggaggacgccaagauccaguucucuaaggagaccuacgaggaggaccuggaggaacugcucggcaagaucggggacgacuacgccgaccuguucauugccaccaagagccuguacgacggcauccuccuggccggcauccuguccacaacggacagcacuaccaaggcgccccucuccagcuccauggugaaccgguacgaggagcaccagaaggaccuggcccugcucaagaacuucauccaccagaaccugagcgacagcuacaaggagguguucaacgacaagcugaaggacggguacgccggcuacaucgaggggaagaccacucaggagaacuucuaccgcuucaucaagaaggccauagagaagaucgaggguuccaacuacuucaucgacaagaucgaccgggaggacuuccuccgcaagcagcggaccuucgacaacgggagcaucccccaccagauucaccuccaggagaugcacgccaucauccgccgccaggcggaguucuaccccuuccuggucgagaaccaggacaagaucgagaagauccugaccuuccgaaucccguacuacgugggcccccuggcccgcgggaaguccgaguucgccuggcugaaccgcaagucagaugagaagauccggcccuggaacuucgacgagaugguggacaaggagaccuccgccgagaacuucaucacgaggaugaccaacuacgaccaguaccuccccgaccagaagguccuuccgaagcacagccugcuguacgagaaauucgccguguacaacgagcucaccaaggugcgcuacgucaccgagcagggcaaguccuucuucuucgacgcgaacaugaagcaggagaucuucgacggcguguucaagguguaccggaaggucacgaaggagaagcugauggacuuccuggggaaggaguucgacgaguuccgcaucguggaccuacugggccuggacaaggacaacaagagcuucaacgccucccucgggaccuaccaugaccugaagaagaucgucagcaaggaccugcucgacaaccccgagaacgaggacauccuggaaaacguggugcuuacccucacccuguucgaggaccgggagaugauccgcaagcgccuggagaaguacaaggacguccucacggaggagcagcgcaagaagcuggagcggcgccacuacaccggcugggggcggcuguccgccaagcucaucaacggcauccgugacaaggugacccggaagaccauccuggacuaccugaucgaugacggcacgagcaaccgcaacuucaugcagcucauaaacgaugacacccugucuuucguggacgagauccggcuggcccaagggagcggcgaggccgaggauuaccgcgcggagguccagaaccucgccgggucccccgccaucaagaagggcauccugcagagccugaagauaguggacgagcucaucgaggugaugggguacgaucccgagcacaucguuguggagauggcccgcgagaaccaguucaccaaccagggccggcgcaacagucaacaacgguauaagaagaucgagaacgcgauaaagaaccuggacagcaaccugaacuccaagauccucaaggaguacccaaccaauaaccaggcccugcagaacgaccgccuguuccucuacuaccugcagaacgguaaggacauguacacggacgaggagcuggacaucgaccagcucagccaguacgacaucgaccacaucaucccccaggccuucaucaaggacgacagccuggacaacaaggugcugaccaaguccgcgaagaaccgggggaaguccgacgacguccccagccucgaaaucgugcacaagaagaagaacuucuggaagcagcugcuggacagccagcucaucucccagcgcaaguucgacaaccugaccaaggccgagcggggcgggcugaccaacgaggacaaggcgcgcuucauccagcggcagcucguggagacccgccagaucacgaagcacgucgcccggauccuggacacccgcuucaacaccaagcuggacgaggccggcaaccggauccgcgaccccaaggugaacaucaucacccucaagagcaaccuggugucccaguuccggaaagacuaccagcuguacaagguccgcgagaucaacaacuaccaccacgcccacgacgccuaccucaacgcggugguggccacggcccugcugaagaaguacccgcagcucgcccccgaguucgucuauggcgacuaccccaaguacaacagcuacaagucccgcaagucugccaccgagaaggugcuguucuacuccaacaucaugaacuucuuccggcgggugcuugucuacagcaagaccggggaggugcgcauccggcccgugauugaggucaacaaggagaccggcgagaucgugugggacaagaaguccgacuuccgcacggugcgcaagguucucagcuacccccaggugaacguggucaagaagguggagaugcagaccgggggcuucagcaaggagagcauccugcagcacggggacuccgacaagcugaucccccggaagaccgagaaguucuaccucgacaccaagaaguacggcggcuucgacagccccacgaucgcguacucggugcugcugaucgccgacaucgagaaggggaaggccaagaagcucaagcgcgucaaggagcugaucggcaucaccaucauggagcggauggccuucgagaagaaccccaucgaguuccuagagcacaagggguacaagaacauccucgagaagaacaucaucaagcugccgaaauacucccuguucgaacucgagaacggccgccggcgccugcuggcgagcgccaaggagcuccagaaggggaacgagaugauccugccgccccaccuggugacccuccuguaccacuccagcaacauccacaagaucaccgagccgauccaccugaacuacgugaacaagaacaagcacgaguucaaggagcuccugcggcacaucuccgacuucagcacgcgcuacauccuggcccaggaccggcucuccaagaucgaggagcuguacgacaagaacgacggcgacgacaucucagaccugaccuccagcuucgucaaccuccugaccuucaccgcaaucggcgcacccgcggcguucaaguuccugggguccgugaucgaccgcaagcgguacacgagcaucgccgaaauccucgaggccacccugauccaccaguccgugaccggccuguacgagacccgcaucgaccucagcaagcucgggggcgacuga

SEQ ID NO: 7743 - RNA, 4107 nt, Artificial Sequence
  Cas9 variant
auggacaagaaguacagcaucggccuggacaucgggaccuccagcaucggguucgugggggucgacgagaacggcuggccccucaacaucaaggggaagcgcgccauaggcgcccaucuguuccgggagggcgaggcggccgccgagacccgaggguuccggacgaccagacggcgcuacaacagacgcaaguggcggcugcggcuccugcgggagaucuucgacgagccgaucucccgcguggacccuaccuucuucgcccggaugaaggagagcucggugagcccgaaggacccaaacuaugacggccuggccaaggagauccucauuccgcgcgacaaggacgggaagauccuguaccccacaaucuaccaccuccgucacgcgcucauguacgaggaccaccaguucgacauccgcgagaucuauuuagccauccaccacaucgucaaguaccgggggcacuuccuccucgacggugccgccaagaacuucgaguccagcaaccuggaccugaaguccgacauccacgagaucaacgcgauccucgugggcauuuucgguaacgagcagguccaguucaacgaucaguauguggagaagcugaaggaggugcugcucgacagcacucagucccgcuccgaccggcagaaggcggccgccaaggugcugcugcccaccaacgaccuagacaaggacacaaccaagaucuuaaagacggucuccaccgagauuaccaaggccaucaccggacugaaggcgaaguucuucgugaucaccggcaacgacaucgccaaggaccagcagaaggacuggaccuucaguaucgacacccuagacgagaagauguccgugaucgagcccagcuucagcgagaagaacuucagccugaucaccauccugcagaaacuuuacuccagcgucacgcuggccgggaucgugccgaacggccuaagccucuccgaagccaugauccagaaguacgaccgccacgccagcgaucuggugcugcucaagaaguacugggacaccaagcccaagguacugaagcaccagcugcagaacaccuacgcggaguacaucgagauccaccaggucguggaugaguuuuacuccgaccucagcaagcugaucaagaacgacgacgacacccuggcccaagagaucaaauccaagaucacgaucggcaacuuccuccccaagcagaggaccaccgagaacggggucauccccuaccagcugcagcagcgcgagcuggauacgaucaucaagaaccagcaggaauacuauccguggcucgcggaggaaaaccccguggcagaccaccaaaucgccuuccccuacaagcuggacgagcuggugggauuccgcauccccuauuacgucgggccgaugaucgcgaaagaggacacgagcaacuccaagaacagcaaguucgcuuggaugauccggaagcaguccggcgaagugacccccuggaacuucgaugagaaaaucgaccgcaccgccagcgcgaccgccuuuaucgaccggaugacgaccaccgacaccuaucucaucggggaggacgugcugccuaagcagucccugaucuaccaacgcuucgagguccucaacgagcugaacaagaucucgaucgacggccagcccaucacgcggaagcagaagcaguccguguacacgcacgucuuugagaagaagaagaccguccaggugaaggacgugcaaaaauuccuggugagcuccggcgaggugaugagccugccgaagaucgggggccucgcgaacgagaagcaguucaacuccagccuguccacccuguacgacuacaacaagaucauccccgacgcccucgaggaccgcaacaaggucgacgacaucgagaagaucauacugugguccacgaucuucgaggauaacagcaucuuuguggagaagcuggacuccaucgacuggcucaccagcucccagaggaagcgccuggcccagaagcgguaccgcggcuggggccggcugagcuugcggcugcugaccaccuucaagaacaaggacggguacuccauccucgacgagcuguggaacagcaaccacaacuucauggagauccaagcccaguccgacuuuagcgagcaaaucgcgaccgccaacaacaacaaccugucccaggugcuccccgccaagugggagcccggccggaagaaucuggccagccuggacgaguucaucuccaaccucuacacgagcccgcagaacaagaaggcccugcggaaggccauccgggucgugcaggacaugaugaccgccgcaggccacaugcccgagaagaucuucauugagguagcccgugacaccuccaacagccaccagcagaccaucgcccggcagcgccaguugcagcagcucuaccaguccgaggcgaaggaggucaucgacagcuccguccgguccgagcuggacgauauccugaagaaccgcgccaacaucaaggaccagcuguuccuguacuuccagcagggcgggcgcgaccuguacacgggcaaggccauaaacaucgacaagcucucacuauaccacaucgaucacauccugccccagucccucgugaaggacgacagccucgacaaccguguccuggugucccagaagacgaacgaggacaagggcgugaccuucgucagcgacaaauacaugaacaacaugcuccccaccuggaaacgcuggcacgagauggggcugaucucugcacggaagcugaagaaccucaccaugagaccggacgagaucgacaaguacgccccugguuucauucagcggcagcugguggagacacgccaagugaccaagcuggucaucgagcuccuggaugcgcugcuaggcaacucccaaaccgagaucaucacgaucaaggcgucccugagccaccaguuccggcagcaguucgaccuggugaagauccgcgaggugaacgacaaccaccacgcauuugacgccuuccucgcggcccgcaucgggaccuaccuguacaagcgcuaccccaagcugcggccguacuucgucuacggccaguauaugcagaaccacaagaaucucaaguccaucaaccugaucaagacccuggacagcgacaaggccaucguugacgaggggaccggcgagauccuaugggacaagaaguccgacuuagccaagaugaucaagaucuauaacuaccagcgccugcucaucacgcacgagagccggaccuccuucggcgccauguacaagcaaaagauccugaaggcgacggacgccaagcagaacgggggaggguucaagcuggugcccaccaagcgcaacuggcccgucgacaucuacggcggguacacgggccagaccgccgccuaccucaccauagugcggguguacagcaagaagaccuccgagcugcgcguccugcccaucuacacgaauaaggugcagcagaucgaaaaggccaugacccagggcgacaaggcgaccaugcucgccuucaagaaggugaucgccccgcagcucgggaaggagaacaaaaagacccaugagaucaagauccccgaguucgacgucguaauccccaaggugcugcucgaccagcuggucaucgacgacaucgccggcagcccccaccgguuccgccuggggacggacacuuacuaccauaacucccagcagcuguuccuaccgcugagcaugcagcggcagcucauggaccgcgaguccgacgacaagguguaucuggacaucuucaacgaugugcugaaacaagucgacucguacuucaaccucuaugacgugaacggcuuccgggccgcgcugcaaaaguccaagaaggccuucgagcagcugcccaucaacgacuuccccaaggacgugcccgacaacaagaagaagaaggggaagcgcagcauccucaaggaaaucuuuaucggcuugcacgccaacgccacccugggcaaccucaagcagauggggaucaaaaccgacuucgggaagcugcagaaguccaacgggcugagaaucacggagaacuguaagaucauucaccagucgcccaccggccucuucgagcggaucguccccaucaaguga

SEQ ID NO: 7744 - RNA, 4107 nt, Artificial Sequence
  Cas9 variant
augagccgccccuacaacaucggccuggauaucgggaccuccagcaucggcugguccgucgucgacgaccagagcaagcucguguccgugcgggggaaguacggcuacgggguccgccuauacgacgagggccagaccgccgccgagcggcgcagcuuccggacgacccgccggcgccugaagcggagaaaguggcggcucggccugcugcgggagaucuucgagccguacaucacccccguggacgacaccuucuuccuccggcagaagcaguccaaccugagccccaaggaccagcgcaagcuguacccccagacgucccucuucaacgaccggaccgaccgcgcguucuacgacgacuauccgaccauuuaccaccucagguacaagcugaugaccgagaagcgccaguucgacauccgggagaucuaccuggccaugcaucacaucgugaaguaccgcgggcacuuccugaacgaggcccccgucagcuccuucaagagcuccgagaucaaccugguggcccacuucgaccggcucaacacgaucuucgccgaccuguucagcgaguccggcuuccagcuggagaccgacaagcucgcggaagugaaggcccugcugcucgauaaccagcagagcgccuccaaccgccagcgccaggcccugagccugaucuacacccccuccaccaacaaggccgucgagaagcagaacaaggccaucgccacggagcuccugaaggccauccuggggcucaaggccaaguucaacgugcugaccggcaucgaggcggaggacgugaaggccuggacccugaccuucaacgccgagaacuucgacgaggagauggugaagcucgagagcagccuggacgacaacgcccaucagaucaucgagucccugcaggagcucuacagcggggugcugcuggccggcaucgugcccgagaaccagucccuuagccaggcgaugaucacgaaguacgacgaccaccagaagcacuugaagaugcugaaggccguccgggaggcccucgcuccggaggaccgccagcggcugaagcaggccuacgaccaguacguggacggccaggaaaacaccaaggcguacuccaaggaagacuucuacggagacaucaccaaggcccugaagaacaaccccgaccaccccaucgugagcgagaucaagaaguuaaucgagcuggaccaguucaugcccaagcagcgcaccaaggacaacggcgccaucccgcaccagcugcaccagcaggagcucgaccggaucaucgagaaccagcagcaguacuaccccuggcuggccgagcugaaucccaauuccaagcgccagacggucgccaaguacaagcucgacgagcugguggcguuucgggugcccuacuacgucgggccgcugaucaccgccgagcagcagcgccagagcuccgacgccaaguucgccuggcugauccggaaggcggagggccgcaucaccccuuggaacuucgacgacaagguggaccggcaggcgagcgccaacgaguucaucaagcgcaugaccacgaccgauaccuaccuccuggccgaagacgugcugcccaagcagucccucaucuaccagcgguucgagguccugaacgaacugaacggccucaagaucgacgaccagcccaucaccacggagcugaagcaggccaucuucaccgaccuguucaugcagaagaucagcgugaccgucaagaacauccaggacuaccucguguccgagaagcgcuacgcgagccggccagccaucaccgggcuguccgacgagaacaaguucaacagccgccuguccacguaccacgaccucaagaugaucgugggcgacgccgucgacgacguggacaagcaggccgaccuggagaaaugcaucgaguggagcaccaucuucgaggacgggaagauuuacuccgccaaacugaacgaaaucgacuggcucaccgaccagcagcgggugcagcuggcugcaaagcgcuaccggggcugggggcgccugagcgcgaaacuccugacccagaucgucaacgccaacggccagcgcaucauggaccugcucugggacacgaccgacaacuucaugcggaucgugcacagcgaggacuucgacaagcugaucaccgaggccaaccagaugaugcuggcggagaacgacgugcaggacgucaucaacgaccucuacaccagcccccagaacaagaaggccuuacgccagauccugcucguggugaacgacauccagaaggccaugaagggccaggcccccgagcggauccugaucgaguucgcgcgcgaggacgaggucaacccccggcuguccgugcagcgcaagcgccagguggagcaggucuaccagaacaucuccaacgagcuccugaacaauaccgagauccggaacgagcugaaggaccucucgaacuccgcccuaagcaacacgcggcuguuccucuacuucaugcagggcggucgcgacauguacacuggggacucccugaacaucgaccggcugagcaccuacgauauagaccacaucuuaccgcagucguucgugaaggacaacagccuggacaaccgcguucuggucucccagaagaugaacagaagcaaggccgaccaggugcccaccgacuucacguccguggagcucggcaagaagaugcagcugcagugggagcagaugcugcgcgccgggcucaucaccaagaagaaguacgacaaucugacccugaaccccgaccacaucagcaaguacgccaugaagggcuucaucaaccggcagcucguagagacccgccaagugaucaagcuggcgacaaaccugcucauggaacaguacggcgaggacaacaucgagcugaucaccgugaaguccgggcugacccaccagaugcggaccgaguucgacuuccccaagaaccgcaaccucaacaaccaccaccaugccuucgacgccuaccugacggccuucgucggucuguaccuccugaagcgguacccgaagcugaagcccuacuucguauacggggaguaccagaaggccagccagcaggacaaguggcgcaacuucaacuuccucaacggucugaagaaggaugagcugguggacgagaacaccgaggcggucaucugggacaaggaguccgggcucgccuaccugaacaagaucuaccaguucaagaagaucuuggugacccgggaggugcacgagaacagcggcgccuuauucaaccagacccuguacgccgccaaggacgacaaggcgagcggccagggcgguaagcaacugauccccgccaagcaggaccgcccgacggccuuauacgggggcuacuccggcaagaccuccgccuaccugugccuggugaagaucaagaacaaguccgaguauaucuaccgcaucuucggggugaacaccucuugguccagcgagcucaagcagauccaggaccccgcggagcggcuggugcgccuggagaagcuccugacgccccagcucaccaucaacaagaagaagaagggugagcccgucccggugaccaaggacuucaagaucauccucccccggauccugaucaaccagaaguucuacucccgcgggcaggacaucagcaucgccuccgaguucuaccugcauaacgagcaagagcucgugcuggacaagagcgacaucaagauccugaacggcgccaucaaggucaacaacuccaacaaacaggugaucaaccucuucaaccacauccuggagcaggucaaccaguauuuccccguuuacgacauuuauaagagccgggaggugcugaacuccagcaaggagaucuuugaaaaccucaccuggaacgaccaguggcgcaaccggaagcugaucaacgugggccagaagaccaucuugaaccgcauccucaucggccugcacgccaacgccgcgcggaucaagaucuccgagcugggcuucaagaacgacuucgggcuccugacgcagaccagcggcaucaccuucacccccgacacgcagaucaucuaccaguccccuacggggcuguucgagcgccggguggcccugcgcgaccucuga

SEQ ID NO: 7745 - RNA, 4107 nt, Artificial Sequence
  Cas9 variant
augaagcgcagcuacaauauugggcuggacaucgggacgaacuccauuggcugggcuauaguggacgaucagagcaaacuaauuagugucaaggggaaguacggcuauggggugcgguuguaugacgaaggacagacggcagcggagcgccggagcuuccgcaccacucggagacggcugaagcgccguaaguggcgccucgguuugcugcgggagaucuucgaaccguacaucacgccaaucgacuccaccuuuuuccuccgccagaaacagagcaacuuguccccgaaggaccagcggaagcuguacccccagacgagccuguucaaugaucgcccugacgcggacuucuaccagcaguacccgacgaucuaccacuuacgguaucagcugaugaccgagaagcgccaguucgacauccgggagaucuaucucgcaaugcaccacaucgugaaguaccgaggacauuuccugaacgaggcccccgucgccuccuuuaagagcagcgagaucaacuuggcugagcacuucgaccagcucaacaccaucuucgccgaccuguuccgggagucaggcuuucaacuggagacggacgaauuaguggccgugaaggcccugcugauggacaaccagcagucggcuagcaaccggcagcggaaggcccuccccaagcuguacacccccucagcugacaagagcaucgagaagcagcgcaaggcaaucgcgaccgaaauacuaaaggccauccuagggcugaaggcgaaguucaacgucgugaccggcauugaagcggaggacgugaaggccugggcccugaccuuuaaugcggagaacuucgacgaagaacucgccaagcuggaguccagccuagacgacaacgggcacgaggucaucggcauacuccaagagcuguacuccggcauccuguuagccggcaucgugccggaaaaucagagccugagccaggccaugaucaccaaguacgaggagcaccaggcccaccugaagaugcucaaggcgguaagggacgaccuggccaccgccgaucagcagaaguuaaagaaggccuacgaccaauauaucgacggccaagagaacaccaaggccuacuccaaggaggccuuuuacgacgacgucacuaaggcccucaaagauuacagcgagcagccccugguguccgagauccagaaacuuaucgagcucgaccaauucaugcccaagcaacggaccaaggacaacggggccaucccccaccagcugcaccagcaggagcuggaccgcauaaucgagaaccaacaacaguauuacccauggcucgccgagcucaaccccaauccuaagcggcaaacggucgcgaaguacaagcuggaugagcucgucgccuuccgcguacccuacuacguugggccauuaaucaccgccgaacagcagcagcagagcaguaaugccaaauucgccuggaugauccggaaaacggagggacgcauaacccccuggaacuucgacgacaaggucgaccggcaggcgagugccaacgaguucaucaagcgcaugaccaccacggacacuuaucugcuggccgaggacgugcucccaaaacagucccucaucuaccagcgguucgaggucuugaacgaacucaacgggcugaaaaucgacgaccagcccauaaccaacgagcugaaacaggccaucuucaacgauuuauucaugcagaagacuagcgucucggugaagaacauccaggacuaccugguuagugagaagagguacgccucccggccagccaucacaggccuguccgacgagaagaaguucaacucccgccugagcaccuaccacgaccugaaggucauugugggagacgccguggacgacguggacaagcaggccgaccucgagaagugcaucgagugguccaccaucuucgaggauggcaagaucuacagcgcuaagcucaacgagauuaccuggcugacggaacaacaacggggccagcuggccaccaagcgcuaccgggguuggggucgccucucggcgaagcugcugacacagauagugaacgcaaacgggcaacggauuauggaccuacugugggacaccacggacaacuucaugcgcaucguccacuucgaggacuucgacaaguuaaucaccgaggccaaccagaugguguuggcggagaaugaugugcaagacgucaucaacgaucuguacacgagcccccagaauaagaaagcgcuccggcagauccuccugguagugaaugacauccagaaggccaugaagggacaagccccagaacgcauucugauagaguucgcucgcggggcccagaaggacaaaucacuaaccguccggcgcaagcggaagcuggacgagauguacagccagaucuccgacgcaguauuggcagacgaguccgugcgccaggaacucaagucauccaaccaggacgaccuggucaaggagaagguguaccuguacuucaugcagggcgggcgggaccuuuacaccggcaacgcccugaacaucgaccggcugucagacuaccacguggaccacaucaucccccaggccuacauuaaggacgacucccucgacaauaaggcgcuggucaguucucggaugaacgagauuaaggcugaccgcgugccacuccaagugguacagaagcaguucgguaagaacauggccucggaguggggguacaugcaccgggccggccugauaucccgcaagaaguacgacaaccugauguucaaccccgagaaucuuaacaaguaccaaaucaaccgguucaucagccgccagcucguggagacgcagcagguuaucaaauugguggccaaccugcucuccaaccaguaugagggggacaacgucaagaucaucaccguaaagucaaagcugacacagacaauccggucggaguucgauuuccccaagaaccgggaggugaacaacuaccaccacgccuucgacgcguaccugacagcuuucgugggcauguaccuccugaaacgauaccccaaguugagcuccuacuucaccuacggggaguaccucaagggcaaccagcaagacaaauggagcuccuucaacuuccugaacgacuugaagcgcgcgaagcucgaggacaagaccaacaaggagaucuucuggcacaaagagagcggccuggccuaccugaacaagaucuaucaguucaagaagauccucgugacccgugaaguccacgagaacagcggggcacuguucaaccagacgcuguacgcagccaaggacgacaaggcguccggccagggcgggaaacaacucaucccggccaagcaggcgcgccccaccgcccuuuaugguggguacuccgggaagacggucgccuacaugugcaucguacggaucaagaacaagaaaggggaucuauacaagguuugcggcguggagaccuccuggcucgcccagcugaagcagcugaaggacgaagacagccagaaggccuuucucaagcagaagaucagcccacaguucacgaaggcgaagaagcagaagggaaccaucguuaaagucguggaagacuucgaggugaucgccccgcacauccugauuaaccaacgcuuauucgacaacggccaggagcucacccugggcagcgccacauacaagcauaacgagcaggagcugauacucgauaagaccgccguuaagcuguugaacggcgagcuccccuuggcccaguccgaggagcuggcggagcuaguguaugacgagauccuggaccagguuaugcacuauuucccacuguacgacacuaaucaauuccgggcuaagcuccuggccggcaaaaccgccuucaugcagcugcccuggaaguccaacccggacgacaauaagaccguccaaaucacgcagcccaucgugcucaagaagauccugcaggggcuccaugcagacgcaggccgcgugucccucaaggagcuggggaugaccaccgacuucggcaugcugcaaaaggcuaccggcaucacguucaccccggacacccaaaucaucuaccaaagccccaccggacuguucgagcgccgggucgcccugagagaccucuga

SEQ ID NO: 7746 - RNA, 4107 nt, Artificial Sequence
  Cas9 variant
auggacaagaaguacagcaucggccuggacaucgggaccaacuccgugggcugggcagucaucaccgacgacuacaagguccccagcaaaaaguucaaggugcuggggaacacggaccgccacuccauuaagaagaaccugaucggcgcccugcuguucgacagcggggagaccgcggaggccacccggcugaagcgcaccgcucgucgccgguacacgcgccggaagaaccgcauuugcuaccugcaggagaucuucaguaacgagauggccaaggucgacgacagcuucuuccaccgccucgaggaguccuuccugguggaggaggacaagaagcacgagcgccacccgaucuucggcaacaucguggacgaagucgccuaccacgagaaauaccccaccaucuaccaccuccggaagaagcucguggacagcaccgacaaggcggaccugcgccugauauaccucgcccuugcacacaugaucaaguuccggggccacuuccugaucgagggggaccucaaccccgacaacuccgacguggacaagcuguucauccagcuggugcagacuuacaaccagcuuuuugaggagaaccccaucaacgccagcggcguggacgcgaaggccauccuguccgcccgccugagcaagucccggcgccucgagaaccugaucgcccagcugccgggggagaagaagaacggccucuucgggaaccugaucgcccugagccucggccugacgcccaacuucaaguccaacuucgaucuggcggaggacgccaagcuccagcugagcaaggacaccuacgacgacgaccuggacaaccuucuggcccagaucggcgaccaguacgccgaccuguuccucgccgcgaagaaccuguccgacgcgauccugcucagcgacauccugcggguaaauaccgagaucaccaaggccccgcuguccgccagcaugaucaagcgcuacgacgagcaccaccaggaccuaacgcugcugaaggcccucguccggcagcagcugcccgagaaauauaaggagaucuucuucgaucagagcaagaacggguacgcgggcuacaucgacgggggcgccagucaggaggaguucuacaaguucaucaagccgauccuggagaagauggacggcaccgaggagcuccuggugaaguuaaaccgcgaggaccugcuccggaagcagcgcaccuucgacaacgggagcaucccccaccagauccaccugggcgagcugcacgccauccuccgccggcaggaggacuucuaccccuuccugaaggacaaccgcgaaaagaucgagaagauccugaccuuccggauccccuacuacguggggccgcucgcccgcggcaacucccgguucgccuggaugacgcgcaagagcgaggagaccaucacccccuggaacuucgaggaggucguggacaagggcgcguccgcccagagcuucaucgagcggaugaccaacuucgauaagaaccugcccaacgagaaggugcugccgaagcacucccuccuguacgaguacuucacggucuacaacgagcugaccaaggugaaguacgugaccgaaggcaugcgcaagccggccuuccucagcggggagcagaagaaggccaucgucgaccugcuguucaagaccaaccggaaggucacggugaagcagcucaaggaggacuacuucaagaagaucgagugcuucgacagcgucgagaucagcgggguggaggaccgcuucaaugcgucccugggcaccuaccacgaccuucucaagaucaucaaggacaaggacuuccuggacaacgaggagaacgaggauauccuggaggacaucguccucacccugacccuguucgaggaccgggagaugaucgaggagcgccucaagacguacgcccaccuguucgacgauaaggugaugaagcagcugaaacggcgccgguacaccggguggggccgccucagccggaagcugauuaacgggauccgcgacaaacaguccggcaagaccauccuggacuuccucaagagcgacggcuucgccaaccgcaacuucaugcagcugauccacgacgacucccugaccuucaaagaggacauccagaaggcccaggugagcgggcagggcgacucccuccacgagcacaucgccaaccuggcggggucacccgccaucaagaagggcauccugcagacggucaaggugguggacgagcucgucaaggugaugggccgccacaagcccgagaacaucgugaucgagauggcacgcgagaaccagaccacccagaagggccaaaagaacucccgggagcgcaugaagcggaucgaggagggcaucaaggagcuggggagccagauccugaaggagcaccccgucgagaacacucagcuccaaaacgagaagcuguaucuguacuaccuccagaacggccgcgacauguacguugaccaggagcuggacaucaaccggcuuagcgacuacgacgucgaccacaucgucccgcaguccuuccucaaggacgacagcaucgacaacaaggugcugacgcgcuccgacaagaaccggggcaagagcgacaacgugcccuccgaggaggucgugaagaagaugaagaacuacuggcgccagcugcucaacgccaagcugaucacccagcguaaguucgacaaccugaccaaggccgagcgcgggggccucuccgagcuggacaaggcgggguucaucaagcggcaguugguggagacccgccagaucaccaagcacgucgcccagauacucgacucccggaugaacacgaaguacgacgagaacgacaagcugauccgcgaggugaagguuaucacccucaagucaaagcucgucucggacuuccggaaggacuuccaguucuacaaggugcgcgagaucaacaacuaccaccacgcccacgacgccuaccugaacgccguggucggcaccgcgcugaucaagaaguaccccaagcucgagagcgaguucgucuacggggacuacaagguguacgacguccggaagaugaucgccaaguccgagcaggagauaggcaaggccacugccaaguacuucuucuauagcaacaucaugaacuucuucaagacggagaucacccuggcaaacggggagauccgcaagcgcccccugaucgagaccaacggcgagaccggcgagaucgugugggauaaggggcgcgacuucgccacggugcggaagguccucuccaugccucaggugaacaucgugaagaagaccgagguccagaccggcggguucagcaaggaguccauccugcccaagcgcaacucagacaagcugaucgcccgcaagaaggacugggaccccaagaaguacggcggguucgacucccccaccguggccuacucgguucucgucguggccaagguggagaagggcaagagcaaaaagcugaaguccgucaaggagcugcucggcaucacgaucauggagcggagcuccuucgagaagaauccgaucgacuuccucgaggcgaagggguacaaggaggugaagaaggaccugaucaucaagcuccccaaguacagccuguucgaguuggagaacggccgcaagcggaugcucgccuccgccggggaguuacagaagggcaacgagcuggcccuccccagcaaguacguaaacuuccuguaccuggccucccauuacgagaagcucaaggggagcccggaggacaacgagcagaagcaacuguucgucgagcagcacaagcacuaccuggacgagaucaucgagcagaucuccgaguucagcaagcgcguaauccucgcggacgcaaaccucgauaaagugcuguccgccuacaacaagcaccgggacaagcccauccgcgagcaggccgaaaacaucauccaccucuucacccugaccaaccugggcgcccccgcggccuucaaguacuucgacaccacuaucgaccgaaagcgcuacacaagcaccaaggagguccucgacgccacccugauccaccaguccaucacgggccuguacgagacccgaaucgaccucagccagcucgggggcgacuga

SEQ ID NO: 7747 - RNA, 4107 nt, Artificial Sequence
  Cas9 variant
auggacaagaaguacagcaucggccuggacaucgggaccaacuccgugggcugggccgucaucaccgaugacuacaaggugcccagcaagaaacucaaggggcugggcaauacggaccgccacgggaucaagaagaaccugaucggcgcccuccuguucgacuccggcgagaccgcggaggcuacccggcugaagcgcaccgcccggcgccgguacacgcgccggaaaaaccgcaucugcuaccuccaggagaucuucagcaacgagauggccaagguggacgauuccuucuuccaccggcuggaggagagcuuccuggucgaggaggacaagaagcacgagagacacccgaucuucgggaacaucguggacgagguggccuaccacgagaaguaccccaccaucuaccaccuccggaagaagcuggcagacuccacggacaaggucgaccugcgccucaucuaccuggcccuggcccacaugaucaaguuccggggccauuuccucaucgagggggaccugaaccccgacaacagcgacguggacaagcuguucauccagcucgugcagaccuacaaccaguuauucgaggagaaccccaucaacgccucccgcgucgacgccaaggccauccugagcgcccggcucuccaagagccgccggcuggagaaccugaucgcccagcucccgggcgagaagaagaacgggcuguucggcaaccugaucgcccucucccugggccugacgcccaacuucaagagcaacuucgaccucgcggaggacgccaagcugcagcuguccaaggacaccuacgaugacgaccucgacaaccugcuggcccagaucggggaccaguacgccgaucucuuccuggccgcgaagaaccugagcgacgccacccuccuguccgacauccugcgcgugaacagcgagaucaccaaggcgccccucuccgcaagcaugauuaagcgguacgacgagcaccaccaggaccugacgcugcucaaggcccuggugcgccagcagcugcccgagaaguacaaggagaucuucuucgaccagagcaagaacggcuacgccggguacaucgacggcggcgccucccaggaggaguucuacaaguucaucaagccgauccucgagaagauggacgggaccgaggagcugcuggccaagcugaaccgggaggaccucuuacgaaagcagcgcaccuucgacaacggcagcauccccuaccagauccaccugggggagcuccacgccauccugcggcgccaggaggacuucuaccccuuccugaaagacaaccgggaaaagaucgagaagauccucacauuccgcauccccuacuacgucggaccucuggcccgggggaacagccgcuucgcguggaugacgcgcaagagcgaggagaccaucacccccuggaacuucgaggaggucguggacaagggcgccuccgcccagagcuucaucgagcggaugaccaacuucgacaagaaccugcccaacgagaagguccuacccaagcacucccugcuguacgaguacuucacgguguacaacgagcuuaccaaggugaaguacguaaccgagggcaugcggaagccggccuuccugagcggggagcaaaagaaggcgaucguggaccuccuguucaagaccaaccgcaaggugacggucaagcagcuaaaggaagacuacuucaagaagaucgagugcuucgacuccguggagaucagcggcguggaggaccgguucaacgccucccuggggaccuaccacgaccuccugaagaucauaaaggacaaggacuuccuggacaacgaggagaacgaggacauccucgaggacaucguccugacccugacccucuucgaggaccgcgagaugaucgaggagcgacugaagacguacgcccaccuguucgacgacaaagugaugaagcagcucaagcgcagaagguacaccggcugggggcggcugagccgcaagcugaucaacggcauccgggauaagcaguccggcaagaccauacucgacuuccucaagagcgacggguucgccaaccgcaacuucaugcagcugauccacgacgacucccucaccuucaaggaggacauccagaaggcccaggucagcggccagggggacucccugcacgagcacaucgcgaaccuggccggcagccccgccaucaagaaggggauccuccagacggugaagguggucgacgaacuggugaaggugaugggccgccacaagcccgagaacaucgucaucgagauggcccgggagaaccagaccacccagaagggccagaagaacagucgcgagcggaugaagcgcaucgaggaggggaucaaggagcugggcagcgacauccucaaggaguaccccguggagaacacccagcugcagaacgagaagcuguacuuguacuaccugcagaacgggcgggacauguacgucgaucaggagcuagacaucaaccgccucagcgacuacgaugucgaccacaucgugccgcaguccuuccugaaggacgacagcauugacaacaaggugcugacgcgguccgacaagaaccgcggcaaaagcgacaacguccccuccgaagagguggugaagaagaugaagaacuacuggcgccagcuccuaaacgccaagcugauuacccagcgcaaguucgacaaccucaccaaggcggagcggggcgggcugagcgagcuggacaaggucggcuuuaucaagcgccagcucguggagacccggcagaucaccaagcacgucgcccagauccuggacucccgcaugaacacgaaauacgacgagaacgacaagcugauccgggagguccgcgugaucacccucaagagcaagcugguguccgacuuccggaaggacuuccaguucuacaagguccgcgagaucaacaacuaccaccacgcccacgacgccuaccugaacgccgugguggggaccgcgcucaucaaaaaguaccccaaguuagagagcgaguucgucuacggcgacuacaagguguacgacgugcggaagaugaucgcuaagucagagcaggagaucgggaaggccaccgccaaguacuucuuuuacagcaacaucaugaacuucuucaagacggaaaucacccuggcgaacggcgagauccgcaagcggccgcucaucgagaccaacggcgagaccggugagaucgucugggacaagggccgcgacuucgccacagugcgcaaggugcuguccaugccgcaagucaacaucgugaagaaaaccgaggugcagaccgggggcuucagcaaggaguccauccugcccaagcggaacagcgacaagcucaucgcccgcaagaaggacugggaccccaaaaaguacgguggcuucgacucccccaccgucgcauacagcgugcugguggucgccaagguggagaagggcaagagcaagaagcugaaauccgugaaggagcuccuggggauaacgaucauggagcggagcuccuucgagaaggacccgaucgacuuccuggaggcgaagggcuacaaggagguccgcaaggaccucauuaucaagcugcccaaguacagccuguuugagcucgagaacgggcggaagcgcaugcuggccuccgccggcgagcugcagaaggggaacgagcucgcccugcccagcaaguaugugaacuuccuguaccucgccagccacuacgagaagcugaagggcagcccggaggacaacgagcagaagcagcuguucguggagcagcacaagcacuaccucgacgagaucaucgagcagaucuccgaguucagcaagcgggucauccuggcggaugccaaccuggacaaggugcucuccgccuacaacaagcaccgcgacaagcccauccgggagcaggccgagaacaucauccaccucuucacccugaccaaccucggcgcccccgcggccuucaaguacuucgacacuacaaucgaccgcaagcgguacaccagcaccaaggaggugcuggacgccacccugauccaccaguccaucacagggcucuacgagacccgcaucgaccugagccagcugggcggggacuga

SEQ ID NO: 7748 - RNA, 4107 nt, Artificial Sequence
  Cas9 variant
auggacaagaaguacagcaucggccuugacaucgggaccaacuccgugggcugggccgucaucaccgacgacuacaagguacccagcaagaaguucaaggugcuagggaacacggaccgccacuccaucaagaagaaccugaucggcgcccuccucuucgacagcggggagaccgcggaggcaacccggcugaagcgcaccgcgcggaggcgguacacccgccggaagaaccgcaucugcuaccugcaggagaucuucuccaacgagauggccaaggucgacgacagcuucuuccaccggcucgaggaguccuuccucguggaggaggacaaaaagcaugagcgccacccgaucuucggcaacauuguggacgaagucgccuaccacgagaaguaccccaccaucuaucaccuccggaagaaacucgccgacagcaccgacaaggcagaccugcgccugauuuaucucgcacuggcccacaugaucaaguuccggggccacuuccugaucgagggggaucucaaccccgacaacuccgacguggauaagcuguucauccagcuggugcagaccuacaaucagcuauucgaggagaaccccaucaacgcgagccgcgucgacgcaaaggccauccucuccgcgcggcucagcaagucccgccggcucgagaaccugaucgcccagcugccgggcgagaagcgcaaugggcuguucggcaaccuuaucgcgcugucccucgggcugacgcccaacuucaaguccaacuucgaccuggccgaggacgccaagcuacagcugagcaaggacaccuacgacgaugaccuggacaaccuccuggcccagaucggcgaccaguacgcagaccuguuccucgcagccaagaaucuguccgacgccauccugcucagcgauauccugcgggugaacucugagaucacgaaggccccgcugagcgccuccaugaucaagcgguacgacgagcaccaccaggaccucacccugcugaaggcgcucguccggcagcagcuacccgagaaauacaaggagaucuuuuucgaccaguccaagaacggcuacgccggguacaucgacggcggggcaagccaagaggaguucuacaaguucaucaagccgauccuggagaagauggacggcacggaggagcuccuggccaagcugaaccgcgaagaccugcuccgaaagcagcggaccuucgacaacggcucgaucccccaccagauccaccugggggaguuacacgccauccuccgccggcaggaggacuucuacccguuuuuaaaggacaaccgcgagaagaucgagaagauccuaaccuuccggauccccuacuacgucggcccgcucgcgcgcgggaacagccgguucgcguggaugacccgcaaguccgaagagacgaucacucccuggaacuucgaggaggugguggacaagggugccagcgcccaguccuucaucgagcggaugaccaacuuugacaagaaccugcccaacgagaagguccugcccaaacacagccuccuguacgaguacuucaccguguacaaugagcugacaaaggugaaguacgucaccgaggggaugcgcaagccugaguuccucuccggcgagcagaagaaggcgaucguggaccugcuguucaagacaaaccggaaggugaccguaaagcagcucaaggaggacuacuucaagaagaucgagugcuucgacucaguggagaucuccggcguggaggaccgcuucaacgccagccuggggacuuaccacgaccuguuaaagaucaucaaggacaaggacuuccuggacaacgaggagaacgaggacauccuggaggacaucguccucacccugaccuuguucgaggaccgggaaaugaucgaggagcgccucaaaacguacgcccaccucuucgacgacaagguuaugaagcagcugaagcggcgccgguacacaggcugggggcgccucuccagaaagcugaucaacgggaucagagacaagcagagcgggaagaccauccuggauuuccucaaguccgacggcuuugcgaaccgcaacuucaugcagcugauccacgacgacagccugaccuucaaggaggacauccagaaggcccaggucuccggacagggggacagucuccacgaacauauugcgaacuuggccggcucccccgccaucaaaaaggggauccugcagaccgugaaaguugucgacgaacucgugaaggugaugggccggcacaagcccgagaacaucgucaucgagauggcccgcgagaaccagacuacccagaaggggcaaaagaacagccgggagaggaugaagagaauugaggaggggauuaaggagcugggcagcgacauccugaaggaguaccccguggagaacacccagcuccagaacgagaagcuguaccuguacuaccuccagaacgggcgcgauauguacguggaccaggagcuugacaucaaccggcuauccgacuacgacgucgaccacaucgugccgcagagcuucaucaaggacgacuccaucgacaacaaggugcucacuagaagcgacaagaaccggggcaaguccgacaauguccccagcgaggagguggugaagaagaugaagaacuauuggaaacaacugcugaacgccaagcucaucacucagcgcaaguucgacaaccugaccaaggcggagcgcgggggccuguccgagcucgacaaggccggcuucaucaagcggcagcuggucgagacccggcagaucaccaagcacguggcccagaucuuagacagccgcaugaacaccaaguacgacgagaaugacaaacucauccgggaggugaaggucaucacgcugaaguccaagcuggugagcgacuuccgaaaggacuuccaguucuacaaggugcgggagaucaacaacuaccaccaugcucacgacgccuacuuaaacgccgucgugggaaccgcccugaucaagaaguaccccaagcuggaguccgaguucgucuacggcgacuacaaggucuacgacgugcgcaagaugaucgccaagagcgagcaggagaucggcaaggccaccgcgaaauacuucuucuacuccaacauuaugaacuucuucaagaccgagaucacgcucgccaacggcgagauacggaagcgcccccucaucgagaccaacggggagaccggcgagaucgucugggacaagggacgggacuucgccaccguccgcaaggugcugagcaugccccaggugaacaucgucaagaagacggagguucagacggguggguucuccaaggaguccauccuccccaagcguaacuccgacaagcugaucgcccggaagaaagacugggaccccaagaaguacggaggguucgacucacccaccguggccuacagcguccuggugguggcgaagguugaaaaggggaaguccaagaagcucaagagcgugaaggagcugcugggcaucacgaucauggagcgcuccagcuucgagaagaacccgauugacuuccucgaggccaagggcuacaaggagguucggaaggaccugaucaucaagcugcccaaguacucccucuucgaguuagagaacgggcgcaagcggaugcuggccagcgccggggagcuccaaaaggggaacgagcuggcccugcccucuaaguacgucaacuuucucuaccuggcaagccacuacgagaagcugaagggcuccccggaggacaacgagcagaaacagcuguuugucgagcagcacaagcacuaccuggacgaaaucauugagcagaucucagaguucucuaagcgcgugauccuggccgacgcuaacuuggacaagguccugagcgccuacaacaagcaccgggacaagcccaucagggagcaggccgaaaacaucauccaccuauucacgcucaccaacuucggggcgcccgccgccuucaucuacuucgacaccacaaucggccggaaccgcuacaaguccaucaaggaggugcuggacgccacgcugauacaccagucgaucaccggccucuacgaaacccggaucgaccugucccagcucgggggcgacuga

SEQ ID NO: 7749 - RNA, 4107 nt, Artificial Sequence; identical to SEQ ID NO: 1949
  Cas9 variant

SEQ ID NO: 7750 - RNA, 4107 nt, Artificial Sequence
  Cas9 variant
auguccagacccuacaacauaggccuagacauagguaccuccuccauaggcuggagcgucgucgacgaccagagcaagcuaguaucagugcgaggcaaguacggcuacggcguccgccuauacgacgaaggccaaacugccgcagaacgccgcaguuucaggacuacgcgucggcgccucaaacgacguaaguggcgucuaggucuauugcgcgaaaucuucgagccauacauuaccccaguagacgacacuuucuuccuccgaaagaaacagaguaaccuaucaccgaaagaccaacggaagcuauacccacagacuucccucuucaacgaccggaccgaccgcgccuuuuacgacgauuacccaacuaucuaccaccuccgcuacaaacuaaugaccgagaaaagacaguucgacauacgagaaauauaucuggccaugcaccacaucguaaaguaccgcggccacuuccucaacgaagcgccagucuccucuuuuaaaagcagugaaauaaaccuggucgcacacuuugaccgucuuaacaccaucuucgcugaccucuuuuccgaguccggcuuccaacucgagacagacaaacuagcagaagugaaagcccuacuccucgacaaucaccaaagcgccucuaacagacaacgccaagcucuccuccuuauauacaccccaucaaccaacaaggccgucgaaaaacaaaacaaagcaaucgccacggaacuacucaaagccauuuuaggacucaaagcuaaguucaacgugcuuacaggaaucgaagccgaagacguaaaaaccuggacgcucacuuucaacgccgaaaacuucgacgaagaaauggucaaacucgaauccucgcucgacgacaacgcacaccaaauaaucgagucucuacaagagcucuacucaggcguacugcuggcaggcauagugccggaaaaccaaucacucagccaagccaugaucaccaaguacgaugaccaccaaaaacaccucaagaugcugaaagccguccgagaagcgcuggcccccgaagacagacaacgccuaaaacaggcauacgaccaauaugucgacggccaagagaacaccaaagcauacuccaaagaagacuucuacggcgacaucaccaaagcauugaagaauaauccggaccauccaauagucuccgagaucaagaaacucauagaacucgaucaauucaugcccaagcaacgaaccaaagacaacggggccauuccccaucaacuccaccaacaagaacucgaucgcauuaucgaaaaccagcaacaauacuacccuuggcucgccgagcucaaccccaacuccaaacgucaaacuguggcaaaauacaaacucgacgaacuuguggcguuccgagucccauacuauguuggcccuuuaauuaccgcagagcaacaacaacaauccucggacgcaaaauucgccuggaugauuagaaaagcagaaggccaaaucacaccauggaacuucgacgacaagguagaccggcaagcauccgccaacgaguucauaaaacgaaugaccacuacagacaccuaccuacucgcagaagacgugcuacccaaacaaucacucauuuaccaacgauucgaaguccuaaacgagcugaacggccuaaagauagacgaccagccuauaacuaccgaacugaagcaagcgauuuuuacagaccuauuuaugcagaaaacaagcgucacagucaaaaacauccaagacuaccucguaucggaaaagcgauacgcaucccgacccgcaaucacuggucugagcgacgaaaacaaguuuaacucccgccucucuacauaccacgaccucaagaccauaguaggagacgcagucgacgacguggacaaacaagcagaccucgagaaaugcauagaaugguccaccaucuucgaggacggaaagaucuacagcgccaaacuaaacgaaaucgauuggcucacugaccagcaacgaguccaacuggccgccaaacgauacagaggcugggguagacucuccgcaaaacuacugacccagaucguaaacgcaaauggccaacgaauuauggaccugcugugggacaccacagacaacuuuaugcgcaucguccacuccgaagacuucgacaaguugauaacggaagcaaaccaaaugaugcucgccgaaaacgacguccaagacgucauaaacgaccucuacacauccccacagaacaaaaaggcccuucgccaaauuuuacuugucgucaacgacauccagaaagcgaugaaaggucaagccccggaaagaauccucauagaauuugcgcgcgaagacgagguaaacccccgacugagugugcaacgcaaacgccagguagaacaaguuuaccaaaauaucagcaaugaacuccucaacaacaccgaaauccguaacgagcucaaagaccucuccaacucagcacuuucaaauacccgcuuauuccuauacuucaugcaaggaggccgggacauguauaccggcgacucccucaacauagaucgacuuucaacguacgauaucgaccacauacuaccacagagcuucauaaaagacaacucccuagacaaccgcguccucguaucucaacgaaugaaccgcucgaaagcagaccaaguccccaccgacuuuacaucaguagaacuagggcagaaaaugcagauucagugggagcagaugcucagagcaggauuaaucacgaaaaagaaauacgacaaccucacccucaaccccgaccacauaucaaaauacgcaaugaaaggcuucaucaacaggcagcuagucgaaacaaggcaaguaaucaaauuagcaaccaaccuccuaauggaacaauacggugaagacaacauagaacucauaaccguuaaauccggacuaacccaccaaaugcgcacugaguucgacuuccccaaaaaccgcaauuugaacaaccaccaccacgcuuucgacgccuaucuaaccgcguucguuggacuauaccuacucaaaagauacccaaaacuuaaaccauacuucgucuauggagaauaccagaaagccucacaacaagacaaauggcguaacuucaacuuccugaaugggcugaaaaaggacgagcucgucgacgaaaacacagaagcagucaucuggaauaaagaauccggacuagcauaucuuaacaaaaucuaccaauucaagaaaauacuugucacuagagagguacacgagaacucaggagcccucuucaaccaaacacucuacgccgccaaagacgacaaagcguccggccaaggaggaaaacagcuuaucccagccaaacaagaccggccaaccgcacuuuauggcggcuacagugggaaaaccguugcauacaugugcauagucagaauaaagaacaagaaaggugaccucuacaaagucugcggagucgaaaccuccuggcuugcucaacuaaaacagcugaccgacgaagacucgaagaaagccuuccucaagcagaaaaucagcccacaauucaccaaaguaaagaaacaaaaaggcaccauaguuaaaguuguggaagacuucgaagucaucgcaccgcacauacuaaucaaccagcgauuuuucgacaacggacaagagcucacccucggcagcgcaacauacaaacacaacgagcaagaacuaauacucgacaaaaccgcagucaaacugcucaacggugcacucccgcuaacccaaagcgaagaacuugcugaacaagucuacgacgaaaucuuagaccaagucaugcacuacuucccucucuacgacaccaaccaauuucgcgcaaaacuaagugccggcaaagccgcuuucaugaagcugccuuggaaaucccagugggauggcaacaaaaugguccaagucggccaacaggugauccucgaccggguacucauaggccuacacgcaaacgcugccguuucugaucucggaguccuaaaaauaagcacaccuuuaggaaagaugcagcaaccgagcggcauuucccucucccccgacacccagauaaucuaccaaagcccuacuggcuuauucgagagacgagucgcgcuccgagaccuauga

SEQ ID NO: 7751 - RNA, 4107 nt, Artificial Sequence
  Cas9 variant
augucgcgccccuacaacaucggccuggacaucgggaccucaagcaucggcugguccguggucgacgaccagagcaagcucgugucggucagagggaaguacggcuacgggguccggcuguacgacgagggccagaccgccgccgagcggcgcagcuuccggacgacccggcggcgccugaagcggcgcaaauggcgccucggucugcucagggagaucuucgagccguauaucacccccguggacgacacauucuuccuacggcagaagcaguccaaccugagccccaaggaucagagaaaacuguacccccagacgucccucuucaacgaccggaccgaccgcgcguucuacgacgacuacccgaccaucuaccaucugcgguacaagcugaugaccgagaagcgccaguucgacauccgggagauuuaccuggcaaugcaccacaucguaaaguaccgcgggcacuuccugaacgaggcccccgucagcucuuucaagucguccgagaucaaccucguggcccacuucgaucggcucaacacuauuuucgccgaccuguucucggagaguggcuuccaguuggaaaccgacaagcucgcggaggugaaggcccugcugcucgacaaccaacagagcgcauccaaccgccagcgccaggcucucagccugaucuacacccccuccaccaacaaagcggucgagaagcagaacaaggccaucgccacugaguugcugaaggccauccuggggcucaaggccaaguuuaauguacugacucggaucgaggcggaggacguaaaagccuggacccugaccuucaacgcugagaacuucgacgaggagauggucaagcucgagagcagccuggacgacaacgcccaccaaaucauagagucauuacaggagcucuauagcggcauccugcuggcugggaucgugcccgagaaccagucccucucucaagcuaugaucaugaaguacgacgaccaccagaagcaccuaaagaugcugaaggccguacgcgaggccuuagccccggaggaccggcaacgcuugaagcaagcguacgaccaguacgucgacgggcaggagaacacgaaggcguacaguaaggaggacuucuacggcgacauaaccaaagcccugaagaacaaccccgaccaccccauugugagcgagaucaagaagcucaucgagcuggaccaauucaugcccaagcagagaaccaaggacaacggggccaucccgcaccagcugcaccagcaggagcucgaccgcauuaucgagaaccagcagcaguacuacccguggcuggccgagcugaacccgaacuccaagcggcagaccgucgccaaguacaagcucgacgagcuggucgccuuccgcgugccuuacuacgugggcccgcugaucacagcagagcagcagcggcagagcucggacgccaaauucgccuggcugauccgcaaggcggaggggaggaucaccccuuggaacuucgacgacaaagucgaccgccaggccagcgccaacgaguucaucaagcggaugacgaccaccgauaccuaccuccuggccgaggacgugcugcccaagcagucccucaucuaccagcgcuucgaggugcugaacgagcugaacggccucaagaucgacgaccagcccaucaccaccgagcugaagcaggccaucuucacggacuuauucaugcagaagaccagcguauccgugaagaauauccaggacuaccucgucucagagaagcgguaugcgucccggccggccaucaccggccugagcgacgaaaacaaguucaacucccgucuguccaccuaccacgaucucaaggccaucgugggggacgccgucgaggacgucgacaagcaggucgaccuggagaagugcguggagugguccacgaucuucgaggacggcaagaucuacagcgccaagcugaacgagaucgacuggcucaccgaccagcagcgcgugcagcuugcugccaagcgguaucgcggcuggggacgacugagugcuaaacuccugacccagaucgugaacgccaacggacagcggaucauggaccugcucugggacaccacggacaacuucaugcgcaucgugcacuccgaggacuucgacaagcugauuaccgaggcuaaccagaugaugcuggcggagaacgacguccaggacgugaucaacgaccucuacaccagcccccagaacaagaaggcucugcgucagaucuuacucguggucaacgacauacagaaggccaugaagggccaggcucccgagcgcauccugaucgaguucgcgcgugaggacgaggugaacccccgccuguccguccagcggaagagacaggucgagcaggucuaucaaaacaucagcaacgagcuccugaacaacacagagauccggaaugagcugaaagaccucuccaacagcgcccuguccaacacccgccuguuccucuauuuuaugcaggguggccgggacauguacacgggcgacagcuuaaacaucgaucgccuguccacguacgacaucgaccacauccucccgcagagcuucaucaaggacaacuccuuagacaaccgggugcuggugagccagaagaugaaccgcuccaaagcggaccagguacccaccgacuucaccucgguggagcuggggaaaaagaugcagcugcaaugggagcagaugcuacgggccggccucaucacgaaaaagaaauacgacaaccugacccugaaccccgaccacaucucuaaguacgcgaugaagggguucaucaaccgccaguuagucgagacacgucaggugaucaagcuggcgaccaacuuacucauggagcaauauggagaggauaacaucgagcugaucacggugaaguccggccugacacaccagaugcggaccgaguucgacuuccccaagaaccggaaccucaacaaucaucaccaugccuucgacgcuuaccucaccgccuuugucggccuguaccuccugaagcgcuacccgaagcugaagcccuauuucguguacggcgaguaccagaaggccucccagcaggacaaguggcgaaacuucaacuuccucaacgggcugaagaaagacgagcugguggacgagaacacagaagcggugauuugggacaaggagucugggcucgccuaccugaacaagauauaccaguucaagaagauacuggugacccgcgaggugcacgagaacagcggggccuuauucaaccagacccuguacgccgccaaggacgacaaggcauccggccaaggagggaagcaguugaucccugcaaagcaggaccgcccgaccgcccucuacggcggguacagcggcaagacggucgccuacaugugcaucgugcggaucaagaacaagaagggcgaccuguauaaagugugcggggucgagaccuccuggcuggcgcagcucaagcagcugaccgacgaagacagccagaaggcguucuuaaagcagaaaauaagcccccaguucacaaaggucaaaaagcagaagggcacgaucgugaagguuguggaagacuucaaggugaucgcgccucauaucuuaaucaaccagcgcuucuucgacaacgggcaggagcugacccugggcagugccaccuacaagcacaacgaacaagaacucauccuggacaagacugccgucaagcugcucaacggggcccugccccugacucaauccgaggaacucgccgaacaggucuacgacgagauccuggaccaggugaugcacuacuucccguuguacgacaccaaccaauuccgggcuaagcucagcgccggcaaagccgcuuucaugaagcugcccuggaaguccaucugggacggaaacaagaugacccagaucgggcagcagaucauccuggaccgcauccucaucggccugcacgccaacgcagccgugagcgaccugggaguccucaagaucuccacuccccuggguaagaugcagcagcccagcggcaucagccugagcccugacacccagaucaucuaccagucucccaccggcuuauucgagcggcgcguggcucuccgggaccuguga

SEQ ID NO: 7752 - RNA, 4107 nt, Artificial Sequence; identical to SEQ ID NO: 1952
  Cas9 variant

SEQ ID NO: 7753 - RNA, 4107 nt, Artificial Sequence
  Cas9 variant
auggacaagaaguauagcaucggccuggacaucgggaccaacuccgugggcugggccgucaucaccgaugacuacaaggugcccagcaagaaguucaaggugcucgggaacacggaccgccacuccaucaagaagaaccugaucggcgcccugcuguucgacagcggggagaccgcggaggccacccggcugaagcgaaccgcccggcgcagguacacgcgccggaagaaccgcaucugcuaccugcaggagaucuucuccaacgaaaucgccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaucuucggaagaagcucgcggacagcaccgacaaggccgaccugcgccugaucuaccucgcccuggcgcacaugaucaaguuccggggccacuuccugaucgagggggaccuaaaccccgacaacuccgacguggacaagcuguucauccagcuggugcagaccuacaaccagcuguucgaggagaaucccaucaacgcgagccgcgucgacgccaaggccauccuguccgcccggcugagcaagucccgucggcucgagaaccugaucgcccagcugccgggcgagaagcgcaacggccucuucgggaaccugaucgcgcugagcuuagggcuaacgcccaacuucaaguccaacuucgaccuggccgaggacgccaagcugcagcugagcaaggacaccuacgacgacgaucuggacaaccuccuggcccagaucggugaccaguacgccgaccuauuccucgcugccaagaaccuguccgaugccauccugcucagcgacauccugagagugaacaccgagaucaccaaggccccgcuguccgccagcaugaucaagcgcuacgacgagcaccaccaggaccucacgcugcugaaggcgcucgugcggcagcagcugcccgagaaguauaaggagaucuucuucgaccagagcaagaacggcuacgccggguacaucgacggcggggccucccaggaggaguuuuacaaguucaucaagccuaucuuggagaagauggacggcaccgaggagcuccuggccaagcugaaccgcgaggaccuacugcgcaagcagaggaccuucgacaacggcagcaucccccaucagauccaccugggggagcugcacgccauccuccgccggcaggaggacuucuaccccuuccugaaggacaaccgcgagaagaucgagaagauccugaccuucaggauccccuacuacgucggcccgcucgcgcgcgggaacucccgguucgccuggaugacgcgcaagagcgaggagaccaucacccccuggaacuucgaggaggugguggacaagggcgccuccgcccagagcuucaucgagcggaugaccaacuucgacaagaaccugcccaacgagaagguccugcccaagcacucccuccuguacgaguacuucacgguguacaacgagcugacaaaggugaaguacgucaccgaggggaugcgcaagccggcguuccucagcggcgagcagaagaaggccaucguggaccuguuauucaagaccaacaggaaggucacggucaagcagcucaaggaggacuacuucaagaagaucgagugcuucgacuccguggagaucagcggcguggaggaccgcuucaacgccuccuuagggaccuaccacgaccugcucaagaucaucaaggacaaggacuuccucgacaacgaggagaacgaggacauccuggaggacaucguccucacacuuacccuguucgaggaccgggagaugaucgaggagcggcucaagacguacgcccaccuguucgacgacaaggugaugaaacagcugaagcggcgccgguacaccggcugggggcgccucagucggaagcugaucaacggcauccgcgacaagcaguccggcaagaccauccucgacuuccuaaagagcgacggcuucgccaaccgcaacuucaugcagcugauucacgacgacucccugaccuucaaagaggaccuccagaaggcgcagguuagcggccagggggauucccuccacgagcacaucgccaaccuggccggcagccccgccaucaaaaaggggauccuccagacggugaagguggucgacgagcuggugaaggugaugggccgacacaagcccgagaacaucgucaucgagauggcccgugagaaccagacgacccagaaggggcaaaagaacucccgggagcgcaugaagcggaucgaggagggcaucaaggagcugggcagcgacauacucaaggaguaucccguggagaccacgcagcugcagaacgagaagcuguaccuauacuaucugcagaacgggcgcgacauguacguggaccaggagcuggacaucaaccggcucagcgacuacgacgucgaucacaucgugccgcaguccuuccugaaggacgacagcaucgacaacaaggugcugacccgcuccgacaagaaccgcggcaagucggacaacguccccuccgaggagguggugaagaagaugaagaacuacuggaagcagcuccugaacgcgaagcugaucacccagcgcaaauucgacaaccucaccaaggccgagcgcggaggccugagcgagcuggacaaggccggcuucaucaagcggcaacucguugagacccggcagaucacgaagcacguggcccagauccuggacucccgcaugaacaccaaguacgacgagaacgacaaguugauccgggaggugcgcgucaucacccucaagagcaagcugguguccgacuuccggaaggacuuccaguucuacaaggugcgcgagaucaacaacuaccaccacgcccacgacgcguaccugaacgccgucguggggaccgcccuuaucaagaaguaccccaaguuagagagcgaguucguguacggcgacuacaaggucuacgacauccggaaaaugaucgccaaguccgagcaggagaucgggaaggcgacggccaaguacuucuucuacagcaacaucaugaacuucuucaagaccgagaucacccuggccaacggcgagauccgcaagcggccccucauugagaccaacggggagacgggcgagaucgugugggacaagggccgcgacuucgccaccgugcgcaagguccuguccaugccccaggugaacaucgugaagaagaccgagguccagacagggggcuucaguaaggaguccauccugcccaagcggaacagcgacaagcucaucgcccgcaagaaggacugggaccccaagaaauacgguggcuucgacucccccaccguggcguacagcgugcuggucguggccaagguggaaaagggcaagagcaagaagcugaaauccgucaaggagcucgugggcaucaccaucauggagcggagcuccuucgagaaggacccgguggacuuucuggaggccaagggcuacaaggagguccgcaaggaccugaucaucaagcuccccaaguauagccuguucgagcuggagaacgggcggaagcgcaugcucgccuccgccggcgagcugcagaaggggaacgaacuggcgcuccccagcaaauacgugaacuuccuguaccuggccucccacuacgagaagcucaagggcagccccgaggacaacgagcaaaagcagcuguuuguggaacagcacaagcacuaccuugacgagaucaucgagcagauauccgaguucagcaagcgggucauccucgccgacgcaaaccuggacaaggugcuguccgcauacaacaagcaccgcgacaagcccauccgggagcaggcggagaacaucauucaccuauucacccugaccaaccugggggcccccgccgccuucaagugcuucgacacgaccaucggccgcaaccgguacaagagcaucaaggaagugcucgacgcgacccucauccaccaguccaucaccggccuguacgagacgcgcaucgaccucagccaguuagggggcgacuga

SEQ ID NO: 7754 - RNA, 4107 nt, Artificial Sequence
  Cas9 variant
auggacaagaaguacagcaucggacuugacauagggaccuccagcaucggcuucguaggggucgacgagaacgguuggccccucaacaucaaagguaagcgcgccaucggcgcccaccuguuccgggaaggcgaggcggccgccgagacccgcggguuucggacgacccgccggcgcuacaaccgacgcaaguggcggcugcgccuccugcgggagaucuucgacgagccgaucuccaggguggaccccaccuucuucgcccggaugaaggagaguuccgugagccccaaggaccccaauuacgacggccuggccaaggagauucucaucccccgcgacaaggacgggaagauacuguaccccacaaucuaccaucucaggcacgcgcugauguacgaggaccaccaauucgacauccgcgagaucuaccuggccauucaccacaucguuaaguacaggggacacuuuuuacucgacggggccgccaaaaacuucgaguccuccaaccuggaccuuaaguccgacauccacgagauuaacgcgauccucgugggcaucuucggcaacgagcagguccaguucaacgaccaguauguugagaaguugaaggaggugcugcuggacagcacgcaguccaggagcgaccggcagaaggccgccgccaaacuucugcuccccaccaaugacuuggacaaagacaccaccaagauccugaaaacugugagcaccgagaucaccaaggccaucaccggccucaaggcuaaguucuucgucauuacgggcaacgacaucgccaaggaccagcaaaaggacuggaccuucagcauugacacccuggacgagaagaugagcgugaucgagcccagcuucagcgagaagaauuuuagcuuaauaacuauacuccagaaacuuuauuccagcgucacgcuggcugggauugucccgaauggccucagcuuguccgaggccaugauccagaaguacgaccgccacgccagcgaccuugugcuccugaagaaguacugggauaccaagcccaaggugcuaaagcaccagcuccagaauaccuaugcggaauacaucgaaauccaccaggucguugacgaguucuacuccgaccugucgaagcugaucaagaacgacgacgacacccucgcccaggagaucaaguccaagaucacgaucggcaauuuccugcccaagcagcggaccaccgagaacggcgugauaccuuaccagcugcagcagcgggagcucgacaccaucaucaagaaccagcaggaguauuacccguggcuggccgaagagaaucccgucgccgaccaccaaauugccuucccuuacaagcucgacgagcucgugggcuucaggauccccuacuacguggggccgaugauagcgaaggaggacacuagcaacagcaaaaacagcaaauucgccuggaugauucggaagcaauccggagaggucacccccuggaacuucgacgagaagaucgaccgcaccgccagcgccacugccuucauugaccguaugacgaccacagacacuuaccugaucggggaggacgugcugcccaagcagucccuuaucuaccagcgcuuugagguuuugaacgagcugaacaagaucagcaucgacggacagccuauaacgcgaaagcagaagcaguccguguacacccauguguucgagaagaagaagaccguccaggugaaggaugugcagaaguuucuggucagcuccggcgaagugaugagccucccgaagaucggcggacuggcgaacgaaaagcaguucaacuccagccugucuacucucuacgacuacaacaagaucauccccgacgcccuggaggacagaaacaagguggacgacaucgagaagaucauccuguggagcacgaucuucgaagacaauagcaucuuugucgagaaacucgacuccauagauuggcugaccucgucccagcggaagcgccuggcucagaagcgguaccggggguggggucggcucagccugcgccuguugaccaccuucaagaacaaggacggauacuccauccuggacgagcuguggaacaguaaccacaauuucauggagauccaggcccaguccgacuucagcgagcaaaucgcgaccgccaacaacaacaaccucucccagguucugccugccaagugggagcccggccguaagaaccuugccucucuggacgaguucaucuccaaccuguacacgagcccgcagaacaagaaggcccugcgcaaggcgauccgggugguacaggacaugaugacagcggccggccacaugcccgagaagaucuucaucgagguggcccgcgauaccuccaacagccaccagcagaccaucgcccgacagcgccagcuccaacagcuguaccaguccgaagauaaggaggugaucgacagcagcguacggagcgagcuggaugacauccugaagaaccgcgcaaacaucaaggaccagcuguuccuguacuuccagcagggcgggcgcgaccucuacacggggaaggccaucaacaucgacaagcugagcuuguaccacaucgaccacauccucccccagagccuggugaaggacgacagccucgacaaccgggugcucgucucccagaaaaccaacgaagauaagggcguuaccuucguuagcgacaaguacaugaacaacaugcugcccaccuggaagcgcuggcacgagauggggcugauuuccgcuagaaaacucaagaaccugacgaugcgcccggacgagaucgacaaguacgcacccggauucauccagcggcagcugguugagacccgccaggugaccaagcucguuaucgagcugcuggaugcacuccugggcaacagccagaccgagaucaucacgauuaaggcgucccugagccaucaguucagacagcaguucgaccucguuaagauccgcgaggugaacgacaaccaucacgccuucgacgccuuccuggccgcccgaaucgggaccuaccuguacaagcgauacccuaaguugcguccguacuucguguacggccaguacaugcagaaccacaaaaaccugaaguccaucaaccugaucaaaacccucgacagcgacaaggcaaucgucgacgaggggaccggcgagauccucugggacaagaaauccgaccuggccaaaaugaucaagaucuacaacuaccagcgccuccugaucacgcacgagagccggaccaguuucggcgccauguacaagcagaagauccucaaggccaccgacgcgaagcaaaacgggggcggguucaagcucgugccgaccaagcguaaccgucccgucgauauauacggcggcuacacgggccagaccgccgccuaccugaccaucguccgcguguacagcaagaaaaccuccgagcugcggguuuuacccaucuacaccaacaagguccagcaaaucgagaaggccaugacccagggcgacaaggccaccaugcuggcguucaagaagguuaucgccccgcagcuggguaaagaaaacaagaaaacccacgagaucaagauccccgaguucgacgugguaaucccgaagguauugcuggaccagcuggugaucgacgacauugccggcucuccucaccgcuuccgccucgggacggacaccuauuaccacaacucccagcagcuauuccuuccgcucagcaugcagcggcagcugauggaccgggaguccgacgacaaggucuaccuggacaucuucaacgacgugcucaagcaggucgacucauacuucaaccuguacgacgugaacggcuuccgggccgcccugcagaaguccaagaaggcguucgagcagcuccccaucaacgacuuccccaaggacgugcccgacaacaagaagaagaaggggaagcgcagcauccuaaaggagauuuucaucggcuuacacgccaacgccacccucggcaaccuuaagcagauggggaucaagaccgacuuuggcaagcugcaaaaguccaacggccuccggaucaccgagaacugcaagaucauccaccaaagcccgacaggccuguucgagcgcaucgugcccaucaaauga

SEQ ID NO: 7755 - RNA, 4107 nt, Artificial Sequence
  Cas9 variant
auggacaagaaguacagcaucggccuggacaucgggaccaacuccgugggcugggccgucaucaccgacgacuacaaggugcccucgaagaaguucaaggugcucgggaacacggaccgccacuccaucaagaagaaccugaucggcgcccugcuguucgacagcggggagauagcggaggccaccagacugaagcgcaccgcccggcgccgguacacccgccggaagaaccgcaucuguuaccugcaggagaucuucuccaacgaaauggccaaggucgacgacagcuucuuccaccggcucgaggaguccuuccugguggaggaggacaagaagcacgagcgccacccgaucuucggcaacaucguggacgaggucgccuaccacgagaaguaccccacgaucuaccaccuucggaagaagcucguggacagcaccgacaaggcggaccugcgccugaucuaccucgcccuggcccacaugaucaaguuccggggccacuuccugauugaaggggaccucaaccccgacaacuccgacguggacaagcuguucauccagcugguccagaccuacaaccagcuguucgaggagaaccccaucaacgccagcggcguugacgcgaaggccauccuguccgcccgccugagcaagucucggagauuggagaaccugaucgcccagcugccgggggagaagaagaacggccucuucgggaaccugaucgcccugagccucggccugacgcccaacuucaaguccaacuucgaccuggcggaggacgccaagcuccagcugagcaaggacacguacgacgacgaccuggacaaccuccuggcccaaaucggcgaccaguacgccgaccuuuuccucgcggcgaagaaccuguccgacgccauccugcucagcgacauccuccgacugaacuccgagaucaccaaggcgccccucagcgccagcaugaucaagcgcuacgacgagcaccaccaggaccugacccugcucaaggcccuggugcggcagcagcugcccgagaaguacaaggagaucuucuucgaccaguccaagaacggguacgccggcuacaucgacgggggcgccagccaggaggaguucuacaaguuuaucaagccgauccucgagaagauggacggcacggaggagcugcuggccaagcugaaccgcgaggaccuccugcggaagcagcgcacguucgacaacggguccaucccccaccagauccaucugggcgagcuccacgccauccugcgccggcaggaggacuucuaccccuuccugaaggacaaccgcgagaagaucgagaagauacucaccuuccggauccccuacuacgucgggccgcuggcccgcggcaacagccgguucgcguggaugacccgcaaguccgaggagaccaucacgcccuggaauuucgaggaggugguggacaagggagccagcgcccaguccuucauagagcggaugaccaacuuugacaagaaccugcccaacgagaaaguccuccccaagcacagccugcuguacgaguacuucaccguguacaacgagcucacgaaggugaaguacgucacggaggggaugcgcaagccggccuuccuguccggcgagcagaagaaagcgaucguggaucuccucuucaaaaccaaccgcaaggugaccgucaagcagcugaaagaggacuacuucaagaagaucgaguguuucgacucgguggagaucuccgggguggaagaccguuuuaacgccagcuugggcaccuaccacgaccuccugaagaucaucaaggacaaggacuuccuggacaacgaggagaacgaggacauccucgaggacaucguccugacgcugacccucuucgaggaccgggagaugaucgaggagcgccugaagaccuacgcccaccuguucgacgacaaggugaugaagcagcucaagcggcgccgguacaccgucugggggcgccugucccggaagcugaucaacggcauccgcgacaagcagagcgggaagacgauccucgacuuccugaaguccgacggcuucgccaaccggaacuucaugcagcuuauccacgacgacucgcucaccuucaaggaggacauccagaaggcccagguguccggccagggggacagccugcacgagcacaucgcgaaccuugccgggucccccgccaucaagaaggggauccuccagaccgugaaggucguggacgagcuggugaaggucaugggccgccacaagcccgaaaacaucgugaucgagauggcccgcgagaaccagaccacgcagaaggggcagaagaauagcagagagcgcaugaagcggaucgaggagggcaucaaggagcugggcagccagauccucaaggagcaccccguggagaacacccagcugcagaacgagaagcuguaccuuuacuaccugcagaacggccgcgacauguacgucgaccaggagcuggacaucaaccggcucuccgacuacgacguggaccacaucgugccgcagagcuucaucaaggacgacuccaucgacaacaagguccugacccguagcgacaagaacagaggaaaguccgacaacgugcccagcgaggaggugguaaagaagaugaagaacuacuggcgccagcugcucaacgccaagcugaucacccagcggaaguucgacaaccugacgaaggcggagcgcgggggccucagcgagcuggacaaggccggcuucaucaagcggcagcugguggagacccgccagaucaccaagcacguggcacagauccucgacagccggaugaacaccaaguacgacgagaacgacaagcugauaagggaggucaaagugaucacccucaagagcaagcuggugagcgacuuccggaaggacuuccaguucuacaagguccgcgagaucaacaacuaccaccacgcccacgacgccuaccugaacgcggugguggggacggcccugauaaagaaauaccccaagcucgaguccgaguucgucuacggcgacuacaagguauacgacgugcggaagaugcuggccaaaagcgaacaggagaucgggaaggccacagcgaaguacuucuucuacuccaacaucaugaacuucuucaagaccgagaucacccuagccaacggcgagauccgcaagcggccccucaucgagacgaacggggagaccggcgagaucgucugggacaagggccgcgacuucgccaccgugcggaaggugcugagcaugccgcaggucaacaucgugaaaaagaccgaggugcagaccgggggcuucuccaaggagagcauccugcccaagcgcaacuccgacaagcucaucgcccgcaagaaggacugggaucccaaaaaguacgggggcuucgacagccccacggucgccuacagcgugcugguggucgccaagguggagaaggggaaguccaagaagcucaagagcgugaaggagcugcugggcaucaccaucauggagcgauccagcuucgagaagaacccgaucgacuuccuagaggccaagggcuacaaggagguccgcaaggaccucaucaucaagcugcccaaguacucccuguucgagcucgagaaugggcggaagcgcaugcuggccagcgccggcgagcugcagaaggggaaugagcucgcccugcccuccaaguacgugaacuuccuguaccucgcgagccacuacgagaagcugaaaggcuccccggaggacaacgagcagaagcagcuguucguggagcagcacaagcacuaccucgacgagaucaucgagcaaaucagcgaguucuccaagcgggucauccuggcugacgccaaccuggacaaggugcucagcgccuacaacaagcaccgcgacaagcccauccgggagcaggccgagaacaucauccaccuguucacccugacgaaucucggggcgcccaccgcauucaaguacuucgacaccaccaucgaccgcaagcgguacacguccaccaaggaggugcuggacgccaccuuuauccaccagagcaucaccggccuauacgagacgcgcaucgaccucucccagcugggaggggacuga

SEQ ID NO: 7756 - RNA, 4107 nt, Artificial Sequence
  Cas9 variant
auggacaagaaguacucaauuggccuggacaucgggaccaauuccgugggcugggcagucaucaccgacgacuacaaggugcccagcaagaaguucaaggugcucgggaacacggaccgccacuccaucaagaagaaccugaucggcgcccugcuuuucgacagcggggaaaccgcggaggccacccggcugaagcgcaccgcccggcgccgguacacgcgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucguggacagcaccgacaaggcggaccugcgccugaucuaccucgcccuggcccacaugaucaaguuccgaggccacuuccugaucgagggggaccucaaccccgacaacuccgacguggacaagcuguucauccagcugguccagaccuacaaccagcuguucgaggagaaccccaucaacgccagcggcguugacgcgaaggccauccuguccgcccgccugagcaagucccggcgccucgagaaccugaucgcccagcugccgggggagaagaagaacggccucuucgggaaccugaucgcgcugagcuugggccugacgcccaacuucaaguccaacuucgaccuggcggaggacgccaagcuccagcugucaaaggacacuuacgacgaugaccuggacaaccuccucgcccagaucggcgaccaguacgccgaccuguuccucgccgcgaagaaccuguccgacgcgaucuuacucagcgacauccuacggcugaacuccgagauaaccaaggccccgcucagcgccagcaugaucaagcgcuacgacgagcaccaccaggaccugacccugcucaaagcccuggugcggcagcagcugcccgagaaguacaaggagaucuucuucgaccaguccaagaacggguacgcgggcuacaucgacgggggcgccagccaggaggaguucuacaaguucaucaagccgauccucgaaaagauggacggcacggaggagcugcuggccaagcugaaccgcgaggaucuccugcggaagcagcgcaccuucgacaacggcuccaucccccaccagauccaccugggcgagcuccacgccauccugcgccggcaggaggacuucuaccccuuccugaaggacaaccgcgagaagaucgagaagauccucaccuuccggauucccuacuaugucgggccgcuggcccgcggcaacagccgguucgcguggaugacccgcaaguccgaggaaacgaucacccccuggaacuucgaggaggugguagacaagggggccagcgcccaguccuucaucgagcggaugaccaacuucgacaagaaccugcccaacgagaagguccuccccaagcacagccuguuauacgaguacuucaccguguacaacgagcucacgaaggugaaguacgucaccgagggcaugcgcaagccggccuuccugaguggcgagcagaagaaggcgaucguggaccuccucuucaagaccaaucggaaggugaccgucaagcagcugaaggaggacuacuucaagaagauugagugcuucgacagcguugagaucuccgggguggaggaccgcuucaacgcgagccugggcacguaccacgaucuccugaagaucaucaaggacaaagacuuccuggacaacgaggagaacgaggacauccucgaggacauaguccugacccugacccucuucgaggaccgggagaugaucgaggagcgccugaagaccuacgcccaccuguucgacgacaaggugaugaagcagcucaagcggcgccgguacaccggguggggacgccugucccggaagcugauuaacgggauccgcgacaaacagagcggcaagaccauccucgacuuccugaaguccgacggcuucgccaaccgcaacuucaugcagcugauccacgacgacucgcucaccuucaaggaggacauccagaaagcgcaggucuccgggcaaggcgacagccugcacgagcacaucgcgaaccuggccgggucccccgccaucaagaagggcauccuccagaccgugaagguggucgacgagcuggugaaggugauggggcgacacaagcccgagaacaucgucaucgagauggcccgcgagaaccagacgacccagaagggccagaagaacagccgggagcgcaugaagcggaucgaggagggcaucaaggagcuggggagccagauccucaaggagcaccccguggagaacacccagcugcagaacgagaagcuguaccucuacuaccugcagaacggccgcgacauguacguggaccaggaguuggacaucaaccggcucuccgacuacgacgucgaccacaucgugccgcagagcuucaucaaggacgacagcaucgacaacaaggugcugacccgcagcgacaagaaccgggggaaguccaacaacguccccagcgaggagguggugaagaagaugaagaacuacuggcgccagcugcucaacgccaagcugaucacgcagcggaaguucgacaaccugacaaaggcggagcgcgggggucucuccgagcucgacaaggccggguucauaaagcggcagcuggucgagacccgccagaucaccaagcacguggcccagauccuugacagccggaugaacaccaaguacgacgagaacgacaagcugauccgcgaggugaaggucaucacgcugaaguccaaacucgugagcgacuuccggaaggacuuucaguucuacaaggugcgcgaaaucaacaacuaccaccacgcccacgacgcauaccugaacgcggucgugggcaccgcccugaucaagaaguaccccaagcucgaguccgaguucguguacggggacuacaaggucuacgacgugcggaagaugaucgccaagagcgagcaggagaucggcaaggccaccgcgaaguacuucuucuauuccaacaucaugaacuucuucaagaccgagaucacgcuggccaacggggagaucaggaagcggccccugaucgagaccaacggcgagaccggcgagaucgugugggacaaggggcgcgacuucgccaccguccggaagguccucagcaugccccaggugaacaucgucaagaagacggaggugcagaccggcggguucuccaaggagagcauccugcccaagcgcaacuccgacaagcugaucgcccgcaagaaagacugggaccccaagaaguacggcggguucgacagccccaccguggccuacagcguccucgugguggcgaaggucgaaaagggcaaguccaagaagcucaaaagcgugaaggagcugcugggcaucaccaucauggagcgguccagcuuugagaagaacccgaucgacuuccuggaggccaagggguauaaggaggugcgcaaggaccugaucgucaagcuccccaaguauucccuguucgagcuggaaaacggccggaagcgcaugcucgcuagcgccggggagcugcagaagggcaacgagcuggcccuccccuccaaguacgugaacuuccuguaccuggcgagccacuacgagaagcucaagggguccccggaggacaacgagcagaagcagcuguucguugagcagcacaagcacuaccuggacgaaaucaucgagcagaucagcgaguucuccaagcgggucauccucgccgacgccaaccuagauaaagugcugagcgcauacaacaagcaccgcgacaagcccauccgggagcaggccgagaacaucauccaccucuucacgcugaccaaccugggcgcgcccgccgccuucaaguacuucgacaccaccaucgaccgcaagcgguacaccuccaccaaggaagugcucgacgccaccuucauccaccagagcaucaccggccuguacgagacgcgcaucgaccugucccagcucgggggcgacuga

SEQ ID NO: 7757 - RNA, 4107 nt, Artificial Sequence
  Cas9 variant
augucucgccccuacaacaucggcuuagacaucgggaccucaagcauuggcugguccguagucgacgaccagaguaagcucguguccgugcgggggaaguacggcuacgggguccgccuguacgacgagggccagaccgccgccgagcggcgcagcuuccggacgacccgccggcgccugaagcgucgcaaguggcgccucggccugcugcgcgagaucuucgagccguacaucacccccaucgacgacaccuuuuuccuccggcagaagcaguccaaccugagcccgaaggaccagcgcaagcuguacacgcagaccucccucuucaacgaccggaccgaccgcgcguucuacgacgacuaucccaccaucuaccaccuccgguaccgccugaugacggagaagcgucaguucgacauccgcgagaucuaccuggccaugcaccacaucgugaaauaccgggggcacuuccugaacgaggccccggugagcucauucaaaagcuccgagaucaaccuggucgcccacuucgaccgcuugaacacgauuuucgcggaccuguucagcgagaguggguuccagcuggaaacggauaaauuagcggaggugaaggcccuccugcucgacaaccagcagagcgccuccaaccgccagcggcaggcccugagccugaucuacacccccuccacgaacaaggcggucgagaagcagaacaaggccaucgccaccgaacuccugaaggccauccuggggcucaaggccaaguucaacgucuugacuggcaucgaggcggaggaugugaaggccuggacccugacguucaacgccgagaacuucgaugaggagauggugaagcucgagagcagccuggacgacaacgcccaccagaucaucgagucgcuacaggagcucuacagcgggguucugcuggccggcaucgugcccgaaaaucagucccucucccaggcgaugaucacaaaguacgacgaccaccagaaacaccugaaaaugcucaaggccguccgcgaggcucucgcccccggcgaccgacagcgccugaagcaggccuacgaccaguacguggacgggcaggagaacaccaaggcguacuccaaggaggacuucuacggcgacaucaccaaggcccucaagaacaacccggaccaccccaucgugagcgagauuaagaagcucaucgagcuggaccaauucaugccgaagcagcgcacgaaggacaacggggcgaucccccaucagcugcaccagcaggagcucgaccgcaucauagagaaccaacagcaguacuauccguggcuggccgagcugaaccccaacuccaagcggcagaccguggccaaguacaaacuugacgaguuagucgcguuccgugugcccuacuacgugggcccccugaucaccgccgagcagcagcggcagagcucggacgccaaguucgccuggcugauccgcaaggcggaggggcggaucaccccguggaacuucgacgauaaggucgaccgccaggccagcgccaacgaguucaucaaacggaugacaaccaccgacaccuaccuccuggccgaggacgugcuacccaagcagagccucaucuaccagcgcuuugaggugcugaacgagcugaacgggcucaagaucgacgaccagcccaucacgaccgaacugaagcaggcaauuuucaccgaccuguucaugcagaagaucagcgucaccgugaagaacauacaggauuaccucgucuccgagaagcgguacgcgagccgacccgccaucacgggccucuccgaugagaacaaguucaacagccggcuguccaccuaccaugaccucaagaugaucgugggggacgccguggacgacguagacaagcaggccgaccuggagaagugcaucgaguggagcaccaucuucgaggacggcaagaucuacuccgccaagcugaacgagaucgacuggcucaccgaccagcagcgcgugcagcuugcggcaaagcgguaccgcggguggggccgccugucagccaagcuccugacgcagaucgugaacgccaacggacaaagaaucauggaucugcugugggacaccaccgacaacuucaugcgcaucguacacagcgaggacuucgacaagcugaucaccgaggccaaccagaugaugcuagcggagaacgacgugcaggacgugaucaacgaccucuacaccagcccccagaacaagaaggcccugcggcagauacugcuugucgugaaugacauccagaaggccaugaaggggcaggcccccgagcgcauccugauugaguucgcucgggaggacgaggugaacucccgccuguccguccagcggaaacgccagguggagcaggucuaccagaauaucagcaacgagcuccugaacaacacggagauccggaacgagcugaaggaccuuuccaauagcgcccuguccaacacgcgccuguuccucuacuucaugcagggcgggcgggacauguacaccggggacagccugaacaucgaccgccuguccaccuacgacaucgaccacauccucccccagagcuucaucaaagacaacucccuggacaaccgggugcuggugagccagaagaugaaccgcuccaaggccgaccaggugcccacagacuucacuagcgucgagcucgggcaaaagaugcagauccagugggagcagaugcugcgggccggccugaucaccaagaagaaguacgacaaccucacccugaacccggaccacaucuccaaguacgccaugaagggcuucaucaaccgccagcugguggagacgcgucaggugaucaagcucgcgacaaaccuguugauggagcaguauggggaggacaacaucgagcucaucaccgucaaaagcggccugacccaccagaugcggacggaguucgacuuccccaagaaccggaacuuaaauaaccaccaccacgccuucgacgccuaccucaccgccuucguggggcuguaccugcucaagcgcuaccccaagcugaagccauacuucguguacggcgaauaccaaaaggccucccagcaggacaaguggaggaacuucaacuuccucaacgggcucaagaaggacgagcuggucgacgagaacaccgaggcggugaucugggauaaggagagcggccuggccuaccucaacaagaucuaccaguucaagaagauacuggugacccgcggcguccacgagaacagcggggcccuguucaaccagacgcuuuacgccgccaaggacgacaaggcguccggccaaggcgggaagcagcugauccccgccaagcaggaccguagcaccgcccuguacggcggguacuccggcaaaaccguggccuacaugugcaucgugcggaucaagaacaagaagggggaccucuacaagguaugcggcguggaaaccagcuggcuggcgcagcugaaacagcucacggacgaggacucccagaaggccuuccuggagcagaagaucagcccccaguucaccaaggugaagaagcagaaggggaacauuaucgaagccgucgaggaguucgaagugaucgcuccccacauccugaucaaccagcgcuucuucgacaacggccaggaguuaacacugggcuccgccaccuacaagcacaacgagcaggagcugauacucgacaagacggccgugaagcuccugaacggcgcccucccgcugacccagagcgaggagcuggccgagcaggucuacgacgagauccucgaccaggugaugcauuacuucccccuguacgacacuaaccaguuccgggccaagcuguccaccggcaaggccgcguucaugaagcuccccuggaagucccagugggacgggaacaagauggugcaggucggccagcagguaauccuggaccgcauccugaucgggcuccacgccaacgccgccaugagcgacuuaaaggugcugaagaugacuacccccuucggcaugauucagcaaaguaccggcaucacccucuccgccgacacgcaaaucaucuaccagagcccgaccggguuauucgagcggcgcguggcgcugcgggaccuguga

SEQ ID NO: 7758 - RNA, 4107 nt, Artificial Sequence
  Cas9 variant
auggacaagaaguacagcaucggccuggacaucgggaccaacuccgugggcugggccgucaucaccgacgacuacaaggugcccagcaaaaaguucaaggugcucggcaacacggaccgccacuccaucaagaaaaaccugaucggcgccuugcuauucgauagcggggagaccgcggaggccacccggcugaagcgcaccgcccggcgccgguacacgcgccggaagaaccgcaucuguuaccugcaggagaucuucuccaacgagauggccaaggucgacgacagcuucuuucaccggcucgaggaguccuuccugguggaggaggacaagaagcacgagcgccacccgaucuucggcaacaucguggacgagguugccuaccacgagaaguaccccacaaucuaccaccuccggaagaaacucguggacagcaccgacaaggcggaccugcgccugaucuaccucgcccuggcccacaugaucaaguuccggggccacuuccugaucgagggggaccucaaccccgauaacuccgacguggacaaacucuucauccagcugguccagaccuacaaucagcuuuucgaggagaaccccaucaacgccagcggcguggacgcgaaggccauccugucagcccgccugagcaagucccggcgccucgagaaccugaucgcccagcugccgggggagaagaagaacggccucuucgggaaccugaucgcccugagccucggccugacgccuaacuucaaguccaacuucgaccuggcggaggacgccaagcuccagcugagcaaggacaccuacgacgacgaccuggacaaccuccuggcccagaucggcgaccaguacgcggaccuguuccucgccgcgaagaaccuguccgacgccauccugcucagcgauauccugcggcuaaacuccgagaucaccaaggccccgcuuagcgccagcaugaucaagcguuacgacgagcaccaccaggaccugacccugcucaaggcccuggugcggcagcagcugcccgagaaguacaaggagaucuucuucgaccaguccaagaacggguacgcgggcuacauugacgggggcgccagccaggaggaguucuacaaguucaucaagccgauccuugagaagauggacggcacggaggagcugcuggccaagcugaaccgcgaggaccuccugcggaagcagcgcaccuucgacaacggcucuaucccgcaccagauccaucugggcgagcuccacgccauccugcgccggcaggaggacuucuaccccuuccugaaggacaaccgcgagaagaucgagaagauccucaccuuccggauccccuacuacgucgggccgcuggcccgcggcaacagccgguucgcguggaugacccgcaaguccgaggagacgaucacccccuggaacuucgaggaggugguggacaagggggccagcgcccaguccuucaucgagcggaugaccaacuucgacaagaaccugcccaacgagaagguccuccccaagcacagccugcuguacgaguacuucaccguauacaacgagcucacgaaggugaaguacgucaccgagggcaugcgcaagccggccuuccuguccggcgagcagaagaaggcgaucguggaccugcuguucaagaccaaccggaaggugaccgucaagcagcugaaggaggacuacuucaagaagaucgagugcuucgacagcguggagaucuccgggguggaggaucgcuucaacgccagccugggcacguaccacgaccuccugaagaucaucaaggacaaggacuuccuggacaacgaggagaacgaggacauccucgaggacaucguccugacccugacccucuucgaggaccgggagaugaucgaggagcgccugaagaccuacgcccaucuguucgacgacaaggugaugaagcagcucaagcggcgccgguacacgggguggggccgccugucccggaagcugaucaacgggauccgcgacaagcagagcgguaagaccauccucgacuuccugaaguccgauggcuucgccaaccggaacuucaugcagcugauccacgacgacagccucaccuucaaggaggacauccagaaggcccaggucuccgggcagggcgacagccugcacgagcacaucgcgaaccuggccgggucccccgccaucaagaaggggaucuuacagaccgugaagguggucgacgagcuggugaaggugaugggccgacacaagcccgagaacaucgucaucgagauggcccgcgagaaccagacgacgcagaagggccagaagaacagccgggagcgcaugaagcggaucgaggagggcaucaaggaguuggggucacagauccucaaggagcaccccguggagaacacccagcuacagaacgagaagcuguaccucuacuaccugcagaacggccgcgacauguacguggaccaggagcuggacauuaaccggcucuccgacuacgacgucgaccauauagugccgcagagcuucaucaaggacgacuccaucgacaacaaggugcugacccgcagcgacaagaaccgggggaaguccgacaacguccccagcgaggagguggugaagaagaugaagaacuacuggcgccagcugcucaacgccaagcucaucacgcagaggaaguucgacaaccugaccaaggcggagcgcggcggccucuccgagcuggacaaggccggguucaucaagcggcagcuggucgaaacccgccagaucaccaagcacguggcccagauccucgacagccggaugaacaccaaguacgacgagaacgacaagcugauacgcgaggugaaggucaucacgcugaaguccaagcucgugagcgacuuccggaaagacuuccaguucuacaaggugcgcgagaucaacaacuaccaccacgcccacgacgccuaccugaacgcggucgugggcaccgcccugaucaagaaguaccccaagcucgagucugaguucguguacggggacuacaaggucuacgacgugcggaagaugaucgcaaaaagcgagcaggagaucggcaaggccaccgcgaaauacuucuucuacuccaacaucaugaacuucuucaagaccgagaucacgcuggccaacggggagauccgcaagcggccccugaucgagaccaacggcgagaccggcgagaucgugugggacaaggggcgcgacuucgccaccguccggaaggugcucuccaugccccaggugaacauagucaagaagacggaagugcagaccggcggguucuccaaggagagcauccugcccaagcgcaacuccgacaagcugaucgcccgcaagaaggauugggaccccaagaaguacggcggguucgacagccccaccguggccuauucgguccucgugguggcgaaggucgagaagggcaaauccaagaagcucaagagcgugaaggagcugcucggccugaccaucauggagcgguccagcuucgagaagaacccgaucgacuuccuggaggccaagggguacaaggaggugaagaaggaccucaucaucaagcugcccaaguacucacuuuucgagcucgagaacggccgcaagcgaaugcuggccagcgccggggagcugcagaagggcaacgagcucgcccugcccuccaaguacguuaacuuccuguaccucgcgagccacuaugagaaacuuaagggguccccggaggauaacgagcagaagcagcuguucguggagcagcacaagcacuaccucgacgagaucaucgaacagaucucggaguucuccaagcgcgugauccuggccgacgccaaccuagacaagguccucucggccuacaacaaacaccgggacaagcccauucgcgagcaggccgagaacaucauacaccuguucacgcugaccaaccucggcgcgcccgcggccuucaaguacuucgacaccaccaucgaccggaagcgcuacacguccaccaaggaggugcuggacgccacccugauccaccagagcaucaccggccucuacgagacgcggaucgaccugucccagcucgggggcgacuga

SEQ ID NO: 7759 - RNA, 4110 nt, Artificial Sequence
  Cas9 variant
augaaacgaauccucggacuggaccucgguacaaacagcauaggcugggcccucgucaacgaggcggaaaccgucaaugagaaaagcuccaucgucaaacuaggaguccgcguaaacccccucacggucgaugaacagaaaaacuucgaggcaggcaagagcauacccacaaacgcaggccguacccuaaaacgaggcaugagaagaaaccuacagcgauacaagcugaggcgagacuacuuaauacaaugccucaaagaauacggcuggauaacaagcgacacgcuacucuacgaaugugguaacaggaccacguucgaaaccuaccgacugcgagcaaaagcaguagacgaggaaauugcauuagaagaacucggccgcguucuccugaugaucaacaagaaacgcggcuacaagucgaaccgcaaagcaaagagcagugacgaaggccaacugaucgacgggauggccaucgcaauggacauguaucacaacggaacgacccccggagaauacgucuauucguuacucagcaaaggaaagaaauauaucccaguauucuaccgcagugacuuacuagacgaguucgacagaauaugggacuaccaaugcgccuacuacccggacauccugacaucgcaguucaaagaacuaauaaggggaaaauccagucaaguaacauccaaauuguucaaacagcaguacaaccuauuuacagcggauaauaaagaaaaagacaagcgccuacaggcauacugcagacgagcagacgcacucaagaaacgccuaccaguugaagagguagcggccgcauugugcgauguaaaccgugaugucaacgcgucauccggguaccugggcacgauaucggaucggagcaagaaacuauucuucaacaaacaaacuguagggcaguaccucaugcuagaacuggacaaagauucccacuucucggugaaaaacgaaguauucuauaggcaagauuaccucaacgaguucgaagccauaugggagaaacaagccgaauaccacccagagcucacaccagaccguaaaaagauacuucgcgauguugucaucuuuuaccaaagacccuuaaaaucacaaaaagacuuaguagcgugcugcgaacucgaacgucgcagaauagagguaaugaaagacggaaaagugagaucagucgaaaucggccccaaagugugcccaaagagcagcccgcuauuucaagauuucaaaauauggcacguacugaacaaccuuaaaguaagagacaaggccacaggcgaugaacgcuuucuagagcucgaugagaaggagauccuguucucagagcucgcgaucaagagcaaacuaucaaagaccgaggcguugaaacuucuauaucagaagccgaaaggccucgaccuaaacuacgauucgguggaagggaacacaacccaagcggcguuauucgaagccuaccagaccgucauagcaaugaccggacacggcgaguacguauucucaaaaaugagcgccuccgaaguaauguccguaguagagggaguauucgggggacucggauucaacacuuccguacugagauucgacucccugcuccaaggaaaagagcuagaaaagcaagacagcuaccgauuauggcaccuccuguacagcuacgagggcgacaauagcgucaccggcaccgauggccucguagcaaaaguagcgagccugcuccgaugugacgaagaauacgcaaaagucgucgcuggggucacuuuccaaccagacuacggaagccugucagcgaaggccauucgaagaauauuaccccacaugagggccggcaaugaauauagccuagccugcgaauacgcgggauacaaacacagcagaagaucccucacgaaagaagaacucgaacagaaagacuacaaggaccaucuagaauuacuccccagaaacucacuacgaaacccgguuguagagaaaauacucaaccagauggugaacgucguaaacgcuguagucgacgccuacggcaaaccagacgaaauacgcauagaaauggccagagaacucaagaaguccgcaaaggaacgcgaagaaaugaccgccgccaucaacaaagcaaccagcgaacacgaaagaauaaaggaaauacucaacaaagaguucggcauccaacauguuucgcacaacgacauaguccgauacaaacucuauugcgaacuuaaaaacaacggauacaaaacacucuacagcgacacauauauaccccaagagaaguuauucagcaaggaagucgacaucgagcacauacuaccacaggcaagacuguucgacgacagcuucagcaacaaaacacuagaguaccgcuccgucaacauagagaaauccaaccagaccgcaugggacuacgucgcagcaaaauggggcgaagaaggaagccugcgcuacaagaaacgaguagacgacuuacuugcggcaggagugauaggaaagucaaaacacgauaaacucuuaaugaagcaagaagacauccccacagacuucaucaacagggaccuccgagacacccaguauaucgcucguaaggcacgagaaauacucgaagaccucguacccaugguggucagcaccacuggagcaguaacagacagauugcgcgaagacuggcaacucgucgacguaaugcaagaacugaacugggacaaauacgccaugaagggccuaacggaagaauggacagacaaagacggccgcaggaucagccgaaucaaagaguggacaaagcgcaacgaccaccgucaccacgcgauggacgcccucacgaucgcguucacaaaacacucauucauacaauaccucaacaaccuaaacgcucgaucugauaaaagcggaagcaucuacgccaucgagcaaaaagaacuauaccgagacaaccacggaaaacugagauucaucaugcccuucgagggcuuccgauccgaagcaaaacgucaacucgaaaacauccuagucagcaucaaagcgaaaaacaaaguggucacgcgcaacguaaacaacgcccguaggggaucgggccgccaggccaagguccaacugaccccgcgggggcaacuccacaacgaaaccaucuauggaucgauccaucgauacguaacaaagcuggaaaaagugggaggaaacuucgacggggaacagaucgcaaaagucgccaaccucagguacagagaggcgcugcaagcgagacacgaagcauuugggggugaugcaaagaaagccuucacgggcaaaaacgcccucgauaaaaacccgcuguaccucaaggacacccgcaccgaagucccacugaaaguaaagaccguaagcacagagacacucuacacgauccgcaaagcagucgccccggaccuaaacguggacaagguaaucgacgcaaaaguccgcaagguacucgaagagaggcugcaagaguauggaggagacccgaagaaagccuucguaaacuuagacgaaaacccaauauaccuaaauaaagccaagggaaucacaauuaaaaggguagccaucaccggggucaacaacgcaaucgcacugcacgacaagaaagacguaggaggacacgugaugcucgacgcguccggucgaaaacagcccguagacuucguuaauacagggaacaaccaccacgucgcaauauaucgagacgccgaagguagcuuacaggaaguaguugucaguuucuacgaagccguggcgcggguaucccuaggacucccggucauagacagagaauaccgaaaagaagacggcuggcaauuccuauucaccaugaaacaaaacgaauacuucguguucccgaacccagaaacaggguucaacccacaagaagucgaccugaccgacgaaacaaacuacgcacugauaagcccgaaccucuuucgaguccagaaguucacgauaaaggacuacuucuuccggcaccaucuggaaacaacaguagaagaccggaaagaacuaaaggacaugacauggaagcgcugcgggcuagggggcaucauaggaaucguaaagguaaggguuaaccacaucggucgcaucgugucagucggagaauacuga

SEQ ID NO: 7760 - RNA, 4110 nt, Artificial Sequence
  Cas9 variant
auggccaagaccuacaacaucggccuggauaucgguaccaacagcauaggcugggccgugguggacgaccagaaccaccucauguccaucaaggggaaguacggcuacggggugcgccuguacgacgagggcaagacggcggaggagcggcguagcuuccggaccacccgccggcgccugaagcggcgcaaguggcggcucucccugcugcgggaaaucuucgaaccccagaucaccccgcucgacaacacguucuuccugcggcaaaagcagagcucacugagcuccaaggacaaccgcaaguuguaccccgagaugagucuauucaacgaccggaccgacaccgauuucuacacccaguaccccacgauauaccaccugucccgcgacuuaaugaccaagaacaagcaguucgauauccgggagaucuaucuagccauguaucacaucgugaaguaccgcggccacuuccugaacgagucucccgucuccagcuucaaguccucggagaucaagcucgccgagaacuucgagacgcugaaccagauauucaacgagcgguucaacgaguccauguuccagcuggccgugaacgacuucgacgaccucaaggcccugcugcucaacgaccagcagagcgcguccaacagacaaaagaaggcccuggggaugaucuacgugccgaacgagaacaagagccuggagaagcagaacaaggccaucgccaccgagcuccugaaggcgaucuugggccucaaggccaaguucaacguccugacggggaucgagguggacgacgccaagcccuggacccuguccuucaacagcgagagcuucgacgaggacaucgacaaggccgccaccaacaucgacgaugacucccgggaaauaaucgcgauccuccagggccuguacagcgggauccugcucgccggcaucauccccgagaaccagagucugagcgaggcuaugguggagaaauacgaccagcacgccgcccaccugaagcagcucaaguccaucuacccucuccugagcauauccgacaagaaggcgauccagcaagccuacaacuacuacauagacggccaggacaacgccaaggccuacagccgcgaggacuucuaugccgcgaccacaaaggcccucaaguccuaccaggacaacgagaccaucgccgagaucuugaagcugaucgagcucgagcaguucaugccgaagcagcggaccaaggacaacggggccaucccccaccagcugcaccagcaggagcuugagcgcaucaucgagaaccagcagaaguacuaccccuggcucgccgagcugaaccccaacgaaagccgccggaagaucgcgaaguacaagcuggacgagcucgucgccuuccgcgugccguacuacgugggcccgcugaucaccuccgagcaacagcagcagagcuccaacaagaaguucgccuggaugauccggaaggccgaggggaagaucacgcccuggaacuucgaugagaaggucgaccgccaggcgagcgccaaugaguucaucaagagaaugaccaccaccgacacguaccucuuagcugaggacguucuccccaagcagucccugguguaccagcgcuucgagguucugaacgaacucaacggcaucaagauagacgacgugccgaucaccguggagcagaagcaacggaucuucaacgaccuauucaugaugcaggccagcgucuccguaaagaacauccaggacuacuuaguauccaagggcuacuucgccucccgccccgagauuacggggcucagcgacgagaacaaggucaucagccggcuguccaccuaccacgaccugaaggcgauucucggcgggaucgucgacgaggccaauaagcaggccgaccuggagaagugcguggaguggagcacgaucuucgaggacggcaagaucuucgucgagaaauuaaacgagaucgaguggcucaccgacgagcagcgcaagcggcuguccucgaagcgcuaccgcggguggggccgccuauccaacaagcuccugaaccagaucgugaacgagaacggccagcggaucauggaccuguugugggacaccaccgacaacuucaugcgcaucguccacagcgaggaguucgacaaacugaucucggccgccaaccagacgcuguuaagcaagaacgacgugcaggaugugaucaacgaccuguacaccuccccgcagaacaagaaggcgcugcggcagauccuccuggucgugagcgacauccagaaggccaugaaaaaccaggcccccucgaagauccugaucgaauuugcccgcgaagacgaggccaauccgcggcucagcgugcagcgcaaacgccaggucgagcagguauaucagaacaucuccaaggacauccucagcgacuccgacgugaaggcggagcugaaggaucucacaaacaccgcccuggccaacacgcggcuguuccucuacuucaugcagggugggcaugacauguacaccggggagacccugaacaucgaucgcuuaagcgaguacgacauagaccauauccucccccaggccuucaucaaggauaacucccuggacaaccgggugcuggugagcgcgaaaaugaaccgcagcaaguccgaucaggugccucucaacgacuacaccgaggagcgguucggcucaaagaugcggguccagugggagcagaugcugcgggccgggcucaucaccaagcgcaaguacgacaaccucacgcuuaaccccgaccggaucuccaaguacgcaaugaagggguucaucaaccgccagcugguggagacccgccaggugaucaagcuagucaccaaccugcugauggaccacuacgaggaugacgaggugcaacucauuaccgucaaaagcggccugauccaccagaugcgggaaauguucgacuucccgaagaaccggaauuuaaacaaccaccaccacgccuucgacgccuaccucacggcguucguagggaucuaccugcugaagcgcuaccccaagcucacccccuuuuucguguacggcuccuaccagaagaacaacaccaacgacaaguggcggaacuucaauuuccugaacgaccugaagaaagaggaggugaucgacagcgacucccacgaggucaucuggaacaaggcccaggggcucguggaguuagacaagaucuaccaguucaagaagauccuggugacccgcgaaguccacgagaacacgggcgcccucuacaaccagacccuguacagcgccaaggacgauaaggccuccggucagggcggcaagcagcugauccccgcgaagcaggaccggccgaccgcccucuacggggguuacagcgggaagaccguggccuacaugugcauugugcgcaucaaguccaagaaggaagacacguacaaggucugcggggugaaaaccagcuggguggccgagcuggagcgguuguccgacaguaacgagcagcuugccagccucaaggcgaaacuuaugcccaaguucaccaaaaacaagaaacagaagggcaagaccauccaggucacggaagacuuugagaucauuguaccccgcguguuaaucaaccagcgguucuaugacaacgggcaggagaucacccuggguagcgccaccuacaagcacaacgagcaggagcugaugcucaauaagaaggccgucaagcuguugaacgggcagcucucccuuguggaggccgagacccuggcgccccagguguaugacgagauccucaagcaagucaugaaguacuucccccuguacgacacgaaccaauuccgcaccaaguugaagaugggcaaggagcaguucaucaagcuccccuggaagaacaaaugggacgggaacaagcugauacacgugggccaacagaccgugcuagaccguauccucaucggccugcacgccaacgccgccguaagcgaccuguccacacucaaggugacgacgcccuucgggaagcugcagcagccgagcggaaucgcccugagucucaacaccaagaucaucuaccaaucccccaccgggcuguucgagcggcgcguggcgcugcgggggcucuga

SEQ ID NO: 7761 - RNA, 4110 nt, Artificial Sequence
  Cas9 variant
auggacaagcccuacaacauuggccuggacaucgggucacacuccaucggcuggaccgugguugacgacaacagcaagcucgugcgcaucaaggggaagcugggcuacggggugcggcuguucgacgagggcaagaccgccgaggagcgccggcaguuccgcacgacccggcgccggcucaagcgccggaaguggcgccugcggcuguuacgcgagaucuucgagccgcacaucgcgccccuggacgagacauucuuccugcggcagaagcaguccaaccucguacccacccagaagaaguugccccaguugagccucuucaacgaccgcuccgacgcggaguucuaccacaaguacccgacgaucuaucaccuaagaaacgcccugaugaccgagaagcgccaguucgaccuccgggagaucuaccuggccauccaccacaucgugaaguaccgcggccacuuccuuaacgccgcccccgcggccagcuucaaguccgggaaguucgaccucgagaacaaauucgaccagcugaaccugcuguucgccagcgcuuacuccgaccuggacuucacgcuacggaccgacaacguggaccaggucaaggcgaucuuacugaacgaggaccugagcgccuccacgagacagcggcaggcccucccccugaucuaccagaccagcgccgaccagaaggccgcgaagaagcugaccaagucccuggccaccgagcugcugaaggccauccucggccugaaggccaaguucgacgugcugacggggaucgagaccgacgacaccaaggccuggcgccucaccuucaacgcggaggacuucgacgacaagcugaacgagcugaacguuacggacaacgaggccgccacccagaucaucgagauccuccgcgagcuguacagcuccauccugcuggccgccaucguccccgagaacuacacccugagccaggcgaugauggccaaguacaacgcccacaagcagcaccugucccuccugcgccaggugaagaccacgcugccggccaagaagcagaaggagcuccaggcggcguacgacgacuacaucgaccagcaccucccccuggacaaguucuacgccaagcugaccaaggugcuccccaaggagaaggacaccgacaacccccagaucauccagauccugaaccugaucgaccucgaccaguuccugccgaagcagcggaccaaggacaacggcgccaucccccaccagcugcaccagcaggagcucgaccagaucaucgacaaccagaaggcauacuaccccuggcuggcgcagcugaaccccaacgagaagcggcagaagaucgccaaauacaagcucgacgagcuggucgccuuccgcgugccguacuacguagggcccuugaucgaggccaagacgcagcagaagaccagcggcgccaacuucgcguggaugauacggaaggagcccggcaccaccacgcccaucaccccguggaacuucgacgagaaagucaaccgccaggccuccgcaaacgaguucaucaagcguaugaccaccacggacaccuaccuacugggggaggacguacugcccaagcauagccuccuguaccagcgcuucgaggugcugaacgagcucaacggcaucaagaucgaccagaagcgggucaccgugcgccagaagcaggccaucuucaacgaccuguuccugaagcagcccaacgugaccgucaagaagcuccagcaguaccugcaggccaagggggaguacgcgucggcccccaucaucacgggccuguccgacccgaagaaguucaacagccagcucuccaccuaccacgaguacaagaagauauucggcgggcugaucgacgaccccgacaagcaggcugacuucgagaagugcaucgaguggagcaccaucuucgaggacucccagauccugaaggacaagcucaaggagaucaacuggcugacccccgagcagcgccacaaaguggccaacaagcguuaccagggcugggggcggcugagcaagaagcuccugacccagcugguggacuacaacggccagcgcaucaucgacauccucuggaacacgaccgauaacuucaugcagaucguccacuccgaggccuucgacaaggcgaucaucaaagagaaccaggcccugcugacccaguacaacccccaggcagugaucgacgaccucuacaccagcccacagaacaagaaggcccuccggcaaauccugcucgucgugaacgacauccagaaggcguuaaaggggcaggcucccucccgcauccugaucgaguuugccagggagggccaggagaacccccgccucagcacgcaacggaagcagcaggucgagaacgccuacaaggaggccuccgacgcgcugcugagcuccgccgaagugcgccaggagcucaagggccuggacaacaaggcccuggccaacacccgcuuguuccuguacuucaugcagggcgggcgggacauuuacaccggcaagagccugaacaucgacgaccugucgaaguacgauaucgaccacauccugccgcaggccuucaucaaggacaacagccuggacaaccgcguacucguguccgcgaaaaugaaccggagcaaguccgaccaggucccccugaacgacuucgccgagauccgcuaugggaagcagaugcggcagcagugggagaagaugcugcgcgccgggcucaucacccggaagaaguaccacaaccucacgcugaaccccgagagcaucaacaaguacaccgccaagggauucaucaaccgccagcucguggagacacgccaggugacuaagcuagccacgaaccugcuaguggaccaguacgcggaggacgacgugcagcugaucaccgucaagagcaaccugacccaccagaugcgggaggaguucgacuuccccaagaaccggaacgucaacaaccaccaccacgccuucgaugccuaccucaccgccuucgugggucuguaucugcucaagcgcuacccgaagcuagcgcccuacuucguguacggggacuaccagaagggagccucccagaacucgaaguggagaaacuucaacuuccuggggaaccuccaccgcgagaaagucguggacaagaacacgggcgagaucaucuggcagcgggacgccgggcugggcgagcugaaccgcaucuacaacuucaagaagauccucgugacccgggcccugcgcgucaaccggggccccauguucaagcagacuaucuacaaggccgaggaggacaaguccagcgggcgcggcuccaagcagcugauccccaccaagaagaaccggccgacggagcucuacgggggcuacaccaacaaggagaccgcguaccugugccuggucaaggagccccacaagaagggcgacaucuaccgcaucugcagugugcucaacauguggcugaccgaacucgaccgcaucgccgaccccaucgccaaggcccagaagcucacggagcugcugacgccccaguucaccaccaccaagaagaagcaggggcagaaaaucccggucgugaagcccuucaagguggucauccccaagauccucaucaaccagcgguucuucucccgcggccaggagcuaaccguggccagccccauguacaugcacaacgagcaggagcuguuucucaacaagaagaccaucaagcugcugaacgggcagcucgcgaagaacgaggcccacgagcuggccccgaagaucuaccagcagauacuggaccaggugaacgacuacuucccccuguacgacauguacaaguuccgggacacccucaacgccuccaaagagaucuucgucaaccugcccuggcaggaccagcgccaggacaagaagaucagccaguccggccaaaagagcauccugaacaagauccucaucgggcugcacgccaacgcggcccggaucaagcugacggagcucaacuucaagagcgacuucggccugcugagccagcgcuccggcaucgccuucagccccgacgaccagaucaucuaccaguccccgaccgggcuguuugagcggcgcgugacccugaaggaccuguga

SEQ ID NO: 7762 - RNA, 4110 nt, Artificial Sequence
  Cas9 variant
augaaggugaacaacuaccacaucggccuggacaucgggaccagcuccaucggcugggucgccaugggcgaggacggcaagccccuccgcgugaaggggaagaccgccaucggcgcgcggcuguuccgcgagggcaacccggccgcggaccggcgcauguuccggacgacccgccggcgccugaaccggcgcaaguggcggcucaagcugcuggacgagaucuucgaccccuacaucacccccguggacucaaccuucuucgcccgccucaagcaguccaacuggagccccaaggacucccggaaggccuucaaagacagcacccucuucccggaccugacggacaagcaguaccaccucgacuaccccaccaucuaccaccuccggcacgcgcugaugacccaggacaagcaguucgacauccggauggucuaccuggcccugcaccacaucguaaaguaccgcgggaacuuccugaacuccacccccguggacaguuucaaggccuccaaagucaacuucgacgaccaguucaagaaacucaacgagcucuacaccgccaucaaccccgaggagagcuuccaaaucaacuucgcgaacuccgagaagaucggccagcaguuccuggauccgagcauccggaaguucgacaagaagaagcagaucuccaagaucgugcccgugaccauggacgacaaggccgucgacaagcucaacgggaagaucgccagcgaaaucgugaacgcaauccugggcuacaaguccaagcuggacguggccguccagugcgaccccgaggacagcaagcccugggcggugaaguucgacgacgaagacaucgacgccaagcuccagaagauccugccagagauggacgagaaccagcaguccaucaucgggaucauccaggaccuguacagccaggugacccucaaccagauuguccccaacggcaugucccugagcgaaagcaugaucaagaaguacaacgaccaccacgaccaccugaagcucuacaagaagcugauuggccagaucuccgacagcaagaagaagacggcccugaagaaggcauacgaccaguacguggggaacgacggcaaggugaucgagcaggacgacuucuacuccagcgucaagaagaaccucgacgacuccgagcugagcaagcagaucauggaccugaucgacgccgacaaguucaugcccaagcagcgcaccucccagaacggggugaucccccaccagcuccaccagcgggagcuggacgagaucaucgagcaccagagcaaguacuacccguggcuggcggaguccaaccccaacaagcacgaccuccaccuggccaaguacaagaucgaggagcugguggcguuccgcauccccuacuacgucggccccaugaucaccccggaggaccagaagaaguccggcgccgccguguucagcuggaugaagcggaaggagcccgggcaaaucacccccuggaacuucgaucagaagguggaccgcauggagagcgcgaacaaguucauaaagcgcaugacgaccaaagacacuuaccucaucggcgaggacguccugcccgacgagucccugcucuacgagaaguucaaggugcugaacgagcugaacaugguccgggugaacggggacagccucaagguggccgacaagcaggccaucuaccaggaccuguucgagaacuauaagcacaucuccgucaagaagaugcagaacuacaucaaagauaagaccggccugccgaacaaccccgacaucagcgggcucuccgaccccgaccacuuuaacaacagccugggcaccuacaacgacuucaagaagcuguucggcgacaagguggacgaccccgaccugcaggacgacuucgagaagaucguggagugguccaccguauucgaggacaagaagauccuccgcgccaagcugaacgagaucagcuggcugagcgacaagcaaaaggacgaccucgagaguagccgguaccagcgcugggggcggcuguccaagaagcugcucaccggcaucgugaacgaccagggggagcgcaucaucgacgagcuguggaacaccaacaagaauuucaugcagauccagagcgacgaugacuucgccaagcggauccacgaggcgaacgccgaucagaugaaagccacggauguggaggacguccuggccgacgcguacaccuccccgcagaacaagaaggccauccgccagguggugaaggucguggacgacauccagcgggcuaugggcgguguggccccgaaguucaucagcaucgaguucacccguuccgaggaccggaacccccgccggaccaucagccgcgagcgccagcucgaggacacgcugaaggacaccgccaagacccuugucaaguccaugaacccggacauccucagcgagcuggacaaugcguccaagagcaagaagggccugaccgaccgcuuauaccuguacuucacgcagcugggccgggacauguacaccgggaagcccaucaacaucgacgagaucuccaacuacgacaucgaccacauccucccccaggccuucaucaaggacgacagccugaguaaccgcgugcuugugagcaaggccgucaacaacgguaaguccgccaacguuccccucaagcuguucggggugaagauggcccacuucuggaagcagcuggcggaggccggccucaucaacaagaggaagcugaagaaccugcagaccaauccggacaccaucagcaaguucgccaugcacggguucauccgccgccagcucgucgagacgagccaggugaucaagcugguggccaacauccugggcgacaaguaccggaacgacgacaccaagaucaucgagaucaccgcccgcaugaaccaccagaugcgggacgaguucgcguucaucaagaaccgcgagaucaacgacuaucaccacgccuucgacgccuaccucaccgccuuccugggccgguaccuguaccaccgcuacaucaagcuccggcccuacuucgucuacggggacuucaagaaauuccgcgaggacaaggugaccaugagaaacuucaacuuccugcacgaccugacggacgacacccaggcgcgcaucgccgacaccgagaccggcgaggugaucugggaccgggagacguccaucaagcagcuccgcgacgucuaccacuacaaguucaugcugaucagccaggagguguacacccugcgcggggccauguucaaccagaccaucuaccccgccgacgaggccggccggaagaagcucauccccaccaaggcggacaaggccguggacgucuacggcggguacuccggcagcaacgacgccuacauggccauugugcggauccacgacaagaagggggacaaguacaagguggucggcgugcccaugcgcgcccuggaucggcugaacgcggccaagaacgugagcgacgccaaguacgaccagguccucaaggacgugcugacgccacaguucaccaagagcaagaagucccgcaagaccggggagaucagccagaccguggaggacuucgaggucgugcugggcaaggugauguaccggcagcucgucaucgacggcgacaagaaguucaugcugggguccagcacguaccaguacaaugccaagcagcuggugcucuccgacgagagcgugaagacccuggccuccaagggcaagcuggacgaggcgcaggagagcgccgccuacgacaacgucuacgacgagauccucgacaagguggaccgcuacuuugcccuguacgaccaacggaacuaccgcaccaaucugcacgagggggaacagaaguucaucggccucccccugcacgacaccuucgacggguccaagaagguggcgaacggcaaacgcgaaacgaucagcgacauccugaacggccuccacgccaacgccaccaugaccaaccugaagguccuggggaucuccagccccuucggcauguuccagucccacgggccgaucaacuuaaaccccgagaccaucauccugugccagucacccacgggccuguucgagcggcgcauaauccuccgggaucuauga

SEQ ID NO: 7763 - RNA, 4113 nt, Artificial Sequence; identical to SEQ ID NO: 1963
  Cas9 variant

SEQ ID NO: 7764 - RNA, 4113 nt, Artificial Sequence
  Cas9 variant
augaacaaacccuauagcaucggccuggacaucgggaccaacuccgugggcuggagcaucauuaccgacgacuauaaggucccggccaagaagaugcgcgugcucgggaacacggacaaggaguauaucaagaaaaaccugaucggcgccuuacuguucgaugggggcaacaccgcggccgaccgucgccugaagcggaccgcccgccggcgcuacacccggcgccggaaucgcauccuguaccuccaagagauauucgccgaggagauguccaagguggacgacagcuucuuccaccggcucgaagacuccuuccuggucgaggaggacaaacgcggcagcaaguaccccaucuucgccacgaugcaggaggagaaguacuaccaugagaaguucccaaccaucuaccaccucaggaaggaguuagcggacaagaaggagaaggccgaccugcgucucaucuaucuggcccuggcccacaucaucaaguuccgcgggcacuuccucaucgaggacgaccgcuucgacgugcggaacaccgacauccagaagcaguaccaggcguuccuggagaucuucgauacuacguucgagaacaacgaccuucucagccagaacguggacgucgaggccauccugaccgacaagauaucuaagucggcgaaaaaggaccgcauacuggcccgguaucccaaccagaaauccaccggcaucuucgccgaguuccucaaacuuauaguggguaaccaggcagacuucaagaagcacuucaaccuggaggacaagaccccgcuccaguucgccaaggacagcuacgacgaggaucuggaaaaccugcucggccagaucggggacgaguucgcugaccuguucagcgccgccaagaagcuguacgacuccgugcuccugagcggcauccucacggucaccgaccucuccaccaaggcgcccuugagcgccucaaugauccaacgcuacgacgagcaccgcgaggaucugaagcagcucaagcaguucgugaaggccagccugcccgagaaguaccaggagaucuucgcggacuccagcaaggacggguacgccggguacaucgaggguaagaccaaccaggaagcguuuuacaaguaccugagcaagcuccugacgaagcaggagggguccgaguaccuguuggagaagaucaagaacgaggacuuccugcgcaagcagcgcaccuucgacaacggcagcaucccccaccaagugcaucugaccgagcuccgggccaucauccgccggcaguccgaguacuauccguuccugaaggagaaccuggaccgcaucgagaagauauuaacauuccggauccccuacuacgucggcccccuggcccgcgaaaaguccgacuucgccuggaugacgcggaagaccgacgacagcauucgccccuggaauuucgaggaccugguggacaaggagaaguccgccgaagcguucauccaccggaugaccaacaaugaucuguaccucccggaggagaagguccugcccaagcacagccugaucuacgagaaguucaccgucuacaacgaacucacgaaggugcgcuuccuagccgagggguuuaaggacuuccaguuccugaaccggaagcagaaggagaccaucuuuaacagccucuucaaggagaagcgcaaggugaccgagaaggacaucaucuccuuccugaacaaggucgacggauacgaggggaucgccaucaagggcauagagaagcaguucaacgccagccuguccaccuaccacgaccucaagaagauccuggggaaagacuuccuggacaacacggacaacgagcucauccuggaagacauagugcaaacgcugacccucuucgaggaccgagagaugaucaggaagcggcucgacaucuacaaggacuucuucaccgagagccagcugaagaagcucuaccgccgccacuacacgggcuggggccgccuguccgcgaagcugaucaacgggauccggaacaaggaaaaccagaagaccauccucgacuaccugaucgacgacggcagcgccaaccgcaacuuuaugcagcugaucaaggacgccggacucaguuucaagccgaucaucgacaaggcucgcaccggcagccacuccgacaaccucaaggaaguagucggggagcuggccggaagccccgcgaucaagaagggcauccuucagagccugaagaucguggacgagcuggugaaagucaugggguacgagccggaacagaucguggucgagauggcccgggaaaaucagaccacugcaaagggccucagccgccugcggcagcgccugaccacccuccgggagagccuggccaacuuaaaguccaacauccucgaggagaagaagcccaaguacgucaaggaccagguggaaaaccaccaccugagcgacgaucgccuguuccucuacuaccugcagaacgggaaggacauguauaccgacgacgagcuggacaucgacaaccucagucaguacgauaucgacuugaucaucccccaggcuuucaucaaggacgacagcaucgacaacaggguccugguguccagcgcgaagaaccgcgguaaguccgacgacgugcccagugucgagauugugaaggacugcaagguguucuggaagaagcuccuggacgccaagcugaugucccagcggaaguaugacaacuuaaccaaggccgagcgcggcggccugaccagcgacgacaaggcccgguucauccagcgccagcuggucgagacccggcagaucaccaagcacguggcccgcauccucgacgagcgguucaacaacgagcuggacuccaagggccgccggauccgcaagguaaagauagucacccucaagagcaaccucgucucaaacuuccggaaggaguucggauucuacaagauccgcgaagucaacaacuaccaucacgcgcacgacgccuacuugaacgccgucguggccaaggcgauccugacgaaguacccacagcucgagcccgaguucguguacggcgacuacccgaaguauaacagcuacaagacccggaaguccgccaccgagaagcuguuuuucuacagcaacaucaugaacuucuucaagaccaaggucacgcuggccgacgggaccgugguggucaaagacgacaucgaggugaacaacgacaccggcgagaucgugugggacaagaagaaacacuuugccaccguacgaaaggugcucucguacccacaggugaacaucgucaagaagacggaaauccagaccggcggguucagcaaggagagcauccuggcccacggcaacagugacaagcugaucccgcgcaagaccaaggacauuuaccucgaccccaagaaguacggcggguucgacagccccauuguggcguacuccgugcugguaguagccgacaucaagaaggggaaagcccagaaguugaagaccgugacggagcuccuggggaucaccaucauggagcggagccgguuugagaagaacccauccgccuuccuggaaagcaagggcuaccucaacauccgggacgacaagcugaugauccugccgaaguacucccucuucgagcuggagaacgggcgccggcgccugcucgccagcgcggacgagcugcaaaaggggaacgagcuggcccuccccacccaguucaugaaauuccuuuaccuggccucccgguacaacgagcucaaggggaagcccgaggagaucgaacaaaagcaggaguucgucgugcagcacguuagcuacuucgaugacauccugcagaucaucaacgacuucuccaaccgcgucauccuggccgacgccaacuuagagaagaucaacaagcuguaccaggacaacaaggagaacaucccgguggacgagcuggcgaacaacaucauaaaccucuucaccuuuacgagccugggcgcccccgccgccuucaaguucuucgacaagaucguggacaggaagcgcuacaccuccacgaaggagguacugaacagcacccucauccaucaguccaucaccgggcuguacgagacccggauagaucugggcaaacucggcgaggacuga

SEQ ID NO: 7765 - RNA, 4113 nt, Artificial Sequence
  Cas9 variant
augaccaagaagaacuauagcaucggccuggacaucgggaccaacuccgugggcugggccgucaucacggacgacuauaaggugcccgccaagaaaaugaaggugcucgggaacaccgacaagaaguacaucaagaagaacuugcugggcgcgcuccuguucgacagcggggagaccgccgaggccacccgccugaagcggacugcccgccggcgcuacacccggcgcaagaaccggcuccgcuaccugcaggagaucuucgcagaggagaugaccaaggucgacgaguccuucuucuaccggcuggacgagagcuuccucaccacggacgagaaggacuucgagcgccacccgaucuucggcaacaaggcagaggaggacgccuaccaccagaaguuccccaccaucuaccaccuccggaacuaccuggccgacuccagcgagaaggccgaucuccgcuuaguguaccuggcgcucgcucacaugaucaaguaccggggccacuuccugaucgaggggaagcugaacgccgagaacaccgacgugcagaaguuauucaccgacuucgucggcguguacgaccgcacuuucgacgacucccaccugagcgagaucaccguggacgucgccuccacccugaccgagaagaucagcaagucccggcgccucgaaaaccugauuaaguacuaccccacggagaaaaagaacacccuguucgggaaccucaucgcccuggcgcugggccuccagcccaacuucaagaugaacuucaagcugagcgaggacgccaagcugcaguucuccaaggacacguacgaagaggaccucgaggagcugcuggggaagaucggcgacgacuacgccgacuuguuuaccagcgccaagaaccuguacgacgccauccugcucuccggcauccugacgguggacgacaacagcaccaaggcgccgcuguccgccagcaugaucaagcgguacguggagcaccacgaggaccucgaaaagcugaaggaguucauaaaggccaacaaguccgagcuguaccacgacaucuucaaggacaagaacaagaacggguacgccggcuacaucgagaacggggucaagcaggacgaguucuacaaguaccucaagaacacccugagcaagaucgacggcagcgacuacuuccuggauaagaucgagcgcgaggacuuccuccggaagcagcgcaccuucgacaacggcuccauuccccaccagauccaccuccaggagaugcacgccauccugcggcggcagggggacuacuaucccuuccucaaggagaagcaggaccgcaucgagaagauccucacguuccggauccccuacuacguggguccgcuggucaggaaggacagccgguucgcgugggccgaguacagaucugacgagaagaucacccccuggaacuucgacaaggucaucgacaaggagaaguccgcagagaaauucaucacccggaugacccugaacgaccucuaccugcccgaggagaaggugcugcccaagcacagccacguguacgagacguacgccgucuacaacgagcucaccaagaucaaguacgugaacgagcaggggaaggagagcuucuucgacucgaacaugaagcaggagaucuucgaccacguguucaaggagaaccgaaaggucaccaaggagaagcugcugaacuaccucaacaaggaguucccggaguaccggaucaaggaccucauaggccuggacaaggagaacaagagcuucaacgccucccucggcacauaccacgaccugaagaagauccuggacaaggcguuccucgacgacaaggugaacgaggaggucaucgaggacaucaucaagacgcugacccuguucgaggacaaggacaugauccacgagcgccuccagaaguacagcgacaucuucaccgccaaucaguugaaaaagcuggagcggcgccacuacaccggcuggggccggcucuccuacaagcugaucaacgggauccgcaacaaggagaacaacaagacgauccuggacuaccucaucgacgacggcagcgccaaccggaacuucaugcagcugaucaacgacgacacucugcccuucaagcagaucauccagaagucccaggucgugggggacgucgacgacaucgaggcaguggugcacgaccuccccggcagccccgcgaucaagaaggggauccugcaguccgucaagaucguggacgagcuggugaaggucaugggcgacaacccggacaacaucgugaucgagauggcccgcgaaaaccagaccaccaaccggggacgcagccagucccagcagcggcucaagaagcugcaaagcucccugaaggagcucgggagcaacauccugaacgaggagaagcccagcuacaucgaggacaagguggagaacucccaccuccagaacgaccagcuguuccuguacuacauccagaacggcaaggacauguacaccggggacgagcuggacaucgaccaccugagcgacuaugacaucgaccacaucaucccccaagccuucaucaaggacgacuccaucgacaaccgcguccugacgagcuccgccaagaaccggggcaagagcgacgacgugcccucccuggacauaguccgcgcccggaaggcggaguggguccggcucuacaagagcggucugaucuccaagcgcaaguucgacaaccugaccaaggccgagcggggcggccucaccgaggccgacaaggccggguucaucaagcgccagcugguggagacccggcagaucacgaagcacguggcccagauccuggacgcgcgcuucaacaccgagcacgacgagaacgacaaggucauccgggacgugaaggugaucacccucaagagcaaccuggucucccaguuccgcaaggacuucgaguucuacaaggugcgggaaaucaacgacuaccaccacgcccacgacgccuaccugaacgccguggucggcaccgcccuccugaagaaguacccgaagcuggcgagcgaguuuguguacggggaguauaagaaguacgacauccgcaaguucaucacgaacagcagcgacaaagccaccgcaaaguacuucuucuacuccaaccucaugaacuucuucaagaccaaggugaaguacgccgacggcaccgucuuugagcggcccaucaucgagacgaacgcggacggcgagaucgccuggaacaagcagaucgacuucgagaaggugcgcaagguguuaagcuacccccaggucaacaucgugaagaagguggagacccagaccgggggcuucuccaaggagagcauccugcccaagggggacagcgacaagcucaucccgcggaagaccaagaaggucuacugggacacaaagaaguacggcggguucgacucccccaccguggcauauagcguguucgucgucgccgacguggagaaggggaaggccaagaagcugaagaccgucaaggagcuggugggcaucuccaucauggagcgcucauucuucgaggagaaccccguugaguuccucgagaacaagggguaccacaauauccgggaggacaagcugaucaagcugcccaaguacucccucuucgaguucgagggcgggcgccggcgccugcuggcgagcgccuccgagcuccagaagggcaacgagaugguccugccgggguaccugguggagcuccuguaccacgcccaccgggccgacaacuucaacagcaccgaguaccugaacuacguguccgagcacaagaaggaguucgagaagguccucagcugcguggaggacuucgccaaccuguacguggacgucgagaagaaccuguccaagauccgcgcgguggccgacagcauggacaacuucuccaucgaggagaucagcaacuccuucaucaaccuccugacgcugaccgcccucggagcgcccgccgacuucaacuuccugggcgaaaagauccccaggaagcgcuacaccagcacuaaggagugccugacggcgacgcucauccaccaguccaucaccgggcuuuacgagacccgcaucgaccugagcaagcucggcgaggaguga

SEQ ID NO: 7766 - RNA, 4113 nt, Artificial Sequence; identical to SEQ ID NO: 1966
  Cas9 variant

SEQ ID NO: 7767 - RNA, 4113 nt, Artificial Sequence
  Cas9 variant
augaacaagcccuacagcaucggccuggacaucgggacaaacuccguggguuggagcauaaucaccgacgauuacaaggucccggccaagaagaugagggugcucgggaacacggacaaagaguacaucaagaagaaccugaucggcgcccuccuguucgacgggggcaacacugcggccgaccggaggcugaagcggaccgccagaaggcgcuacacccgucgccggaaccgcauccuguaccuccaggagaucuucgccgaggagauguccaagguggacgacagcuucuuccaccggcuugaggacuccuuccuggucgaggaggacaagcgcgguagcaaguaccccaucuucgccacgaugcaggaggaaaaguacuaccacgagaaguuccccacgaucuaccaccuccggaaggagcuagcggacaagaaggagaaggccgaccugcgccuaaucuaccuggcccuggcccacaucaucaaguuccgggggcacuuccucaucgaggacgaccgcuuugaugugcggaacaccgacauccagaagcaguaccaggcuuuccuggagaucuucgacaccacguucgagaacaacgaccuucucagccagaacguggacguagaggccauccugaccgacaagaucagcaagagcgccaagaaggaccgcauccuggcccgguaccccaaccagaaguccaccggaaucuucgccgaguuccucaagcugaucguggggaaccaggcagacuucaagaagcacuuuaaccuggaggacaagaccccgcuccaguuugccaaggacagcuacgacgaggaccuggagaaucugcucggccagaucggggacgaguucgccgaccuguucagcgccgccaagaaacuuuacgacuccgugcuccugaguggcauccugacggucaccgaccucuccaccaaggcgccccucagcgccuccaugauccagcguuacgacgagcaccgggaggaccugaagcagcucaagcaguucgugaaggccagccugcccgaaaaguaccaagagaucuucgccgacuccagcaaggacggcuacgccggguacauagagggcaagacaaaccaagaggcguucuacaaguaccugagcaagcuccuuacgaagcaggagggcuccgaguaccugcucgagaagauaaagaacgaggacuuccugcgcaagcagcgcaccuucgacaacggcagcaucccacaccagguccaccugaccgagcuccgggccaucauccggcggcagucggaauauuaccccuuccugaaggagaaccuggaccgcaucgagaagauccugacuuuucggauccccuacuacgucggcccccuggcccgagagaaguccgacuucgccuggaugacgcggaagaccgacgacagcauccgccccuggaacuucgaggaccugguagacaaggagaaguccgccgaggccuuuauccaccggaugaccaacaacgaucuguaccucccggaggagaaggugcuccccaagcacagccuaaucuacgagaaguucaccgucuacaacgagcucacaaaggugagauuccuggccgagggguucaaggacuuucaguuccugaaucggaaacagaaggagacaaucuuuaacagccucuucaaggagaagcgcaaggugaccgagaaggacaucaucuccuuccugaacaagguugacggcuacgaggguauugccauaaagggcaucgagaagcaguucaaugccagccuguccaccuaccacgaccucaagaagauacuggggaaagacuuccuggacaacacggacaacgagcucauccuggaggacaucguccaaacccuuacccucuucgaagaccgggagaugauccgcaagcggcuggauaucuacaaggacuucuucaccgagucacagcugaagaagcucuaucgccggcacuacaccggcuggggccgccuguccgcuaagcugauaaacgguauccggaacaaagagaaccagaaaaccauucucgacuaccugaucgacgacgguucggccaaccgcaacuucaugcagcugaucaaggacgccgggcucucauuuaagcccaucaucgacaaggcccgcaccggcucccacuccgacaaccugaaggaggugguuggggagcuagcaggcagccccgcgaucaagaagggcauccuccagucccugaagaucguggacgagcuggugaaggucaugggauacgagccggagcagaucguggucgagauggcccgggagaaccagaccacggccaaaggccucagccgcagccggcaaagacugacgacacugcgggagagucucgccaaccucaagagcaacauccuggaggagaagaaacccaaguaugugaaggaccagguggagaaccaccaccuuuccgacgaccgccuguuccuguacuaccuccagaacgggaaggacauguacaccgacgacgagcuugacaucgacaaucugucccaguacgauaucgaccacaucauuccccaggccuucaucaaggacgacuccaucgacaaucgggucuugguaagcuccgcgaagaaucgcggcaagagcgacgacgugcccuccgucgagaucgugaaggacuguaaaguguucuggaagaagcugcuggacgcaaaauugaugagccagcggaaauacgacaaccugaccaaagccgagcgcgggggccugaccuccgaugacaaagcccgguucauccagcgccagcucgucgagacccggcagaucaccaagcacguggcccgcauccuugacgagcgguucaacaacgagcuggacagcaagggccgccggauccgcaaggugaagaucgucacccucaagagcaaccuggugagcaacuuccggaaggaguucggguucuacaagauccgcgaggugaacaacuaccaccacgcgcacgacgccuaccugaacgccgugguggccaaggcgauccucacgaaguacccgcagcuggaacccgaguucguauacggggacuaccccaaguacaacuccuacaagacccgcaagagcgccaccgagaaacuguucuucuacuccaauaucaugaacuuuuucaagaccaaggucacgcucgccgacggcaccgugguggucaaggacgacaucgaggugaacaacgacaccggcgagaucgugugggacaagaagaagcacuucgccaccgucagaaaagugcugagcuacccccaggugaacauagucaagaagacagagauccagaccggcggguucagcaaggaauccauccuggcccacggcaacagcgacaagcucaucccgcgcaagaccaaggacauuuaucuugaccccaagaaguacgggggcuucgacucccccaucguggcguacagcgugcuggucguggccgacaucaagaaagggaaggcccagaagcucaagacggugacggaguugcuggggaucacaaucauggagcggucccgcuucgagaagaaccccagcgccuuccucgaguccaagggcuacuuaaacauccgggacgacaagcugaugauccucccgaaguacagccuguuugagcuggagaacgggcgccggcgccuccuggccuccgcgggcgagcugcagaaggggaacgagcucgcccugcccacacaguucaugaaguuccuguaucucgccagccgguauaacgagcugaagggcaagcccgaggagaucgagcagaagcaggaguucgucguucagcacguguccuacuucgacgacauccuacagaucaucaacgacuucagcaaccgcgucauccucgccgacgccaaccuagagaagaucaacaagcuguaccaggacaacaaggagaauaucccgguggaugagcuugcgaacaacauaaucaaccuguucaccuucacgucccugggggcccccgcugccuucaaguucuucgauaagaucguugacaggaagcgcuacaccagcaccaaagagguccucaacuccacccugauccaccagagcaucacgggccuguacgagacgcggaucgaccucggcaagcugggggaagauuga

SEQ ID NO: 7768 - RNA, 4113 nt, Artificial Sequence; identical to SEQ ID NO: 1968
  Cas9 variant

SEQ ID NO: 7769 - RNA, 4113 nt, Artificial Sequence
  Cas9 variant
augaccaagaucaaggacgacuacaucgugggacuggauaucgggaccgacagcugcggcugggucgccaugaacuccgacaacgacauccucaagcugcaggggaagacggccaucggcagccaccuguucgaggcggggaaguccgccgccgaccgccgccucuuccggaccacacaccggcgcaucaagcggcgccgguggcgccugaaacuucucgaggaguucuucgaccccuacauggccaagguggacccauacuucuucgcccggcugaaggagucaggccugagcccccucgacaagcgcaagaacguguucuccaucgucuuccccaccgcggccgaggacaagaaguucuacgacgacuaccccacgaucuaccaccuccgguacaagcugaugaccgaggacgagaaguucgaccuccgggagguguaccuggcgauccaccacaucaucaaguacagaggcaacuuccuguacaacaccuccgugaaggacuucaaggccagcaagaucgacgucaaguccagcaucgagaagcucaacgagcuguacgagaaccuggggcucgaccugaacguggaguucaacaucuccaacaccgcagagaucgagaagguucucaaggacaagcagaucuucaagcgcgacaaggucaagaagaucgccgagcuguucgccaucaagacggacaacaaggagcagagcaagcggaucaaggacaucuccaagcaggucgccaacgccgugcugggcuacaagacccgcuuugacaccaucgcgcuuaaggaggugagcaaggacgagcucuccgacuggaacuucaagcugagcgacaucgacgccgacuccaaguucgaggcccugauggggaaccuagacgagaacgagcaggccauccugcugaccaucaaggagcuguucaacgccgugacgcucaacggcaucguggaggacgggaacacccugagcgaguccaugaucaacaaguacaacgaccaccgggacgaccucaaguuacugaaggaggucaucgagaaucacaucgaccgcaaaaaggcggugaagcucgcacuggccuacgaccuguacgugaacaaccgucacggccagcucauccaggccaagaagaagcugggcaagaucaaaccggggagcaaggaggacuucuacaaggucgugaacaagaaccuggacgacucgcaggccuccaaggagaucaaaaagaagaucgagcucgacagcuucaugcccaagcagcgcaccaacgcgaacggcgugauccccuaccaacugcaucagcuggagcucgacaagaucaucgagaaccaauccaaguacuaccccuuccugaaggagaucaacccggucagcucccaccugaaggaggcccccuacaagcucgacgagcugauccgguucagggugcccuacuacguggggccccugaucagcccgaacgaguccaccaaggacauucaaacgaagaagaaccagaacuucgccuggaugauccgcaaggaggagggccggaucacccccuggaacuucgaccaaaaggucgaccgcauugagagcgccaacaaguucaucaagcggaugacuaccaaggacacguaccuguucggcgagaacgugcuccccgccaacucccugcuguaccagaaguucaccguccucaacgagcugaacaacauccgcaucaacgggaagcggaucagcguggaccugaagcaagagaucuacgagaaccucuucaagaagcacaccaccgugacggucaagaagcuggagaacuaccugaagcagaaccacaaccucgugaagguggagauaaagggccuggcggacgagaagaaguucaacuccgggcugaccacuuacaaccgcuucaagaaccucaacaucuucgacaaccagaucgacgaccugaaguaccggaaggacuucgagaagaucaucgaguggagcaccaucuucgaggacaaguccaucuacaaggagaagcugcgcagcaucgacuggcucaacgagaagcagaucaacgcccuauccaacauccggcugcagggcugggggcgccucagcaagaagcugcuggcccagcuccacgaccacaacggccagacgaucaucgagcagcugugggacucccagaacaacuucaugcagaucgucacccaggccgacuucaaggacgcgaucgccaaggccaaccagaaccugcuaguggccaccagcguagaggauauccugaacgacgccuacaccucccccgcgaacaagaaggccaucaggcaggucaucaaggugguggacgacaucgucaaggccgccagcggcaagguaccgaagcagaucgccaucgaguucacgcgcgacgcggacgacaaccccaagcggagccagacccgcgggaguaagcugcagaagguguacaaggacuuaagcaccgagcuggccuccaaggccaucgccgaggagcugaacgaggccaucaaggacaaaaagcucguccaggacaaguacuaccuguacuucaugcagcugggccgggacgcguacaccggcgagcccaucaacaucgacgagauccagaaguacgacaucgaccacauccucccccagagcuucaucaaggacgacgcccuggacaaucgcgugcugguguccaaggccgucaacaacgauaagagcgacaacgugccggugaagcuguucggcaacgagauggccgggaaccucggcaucacgauucggaagaugugggaggaguggaagaacaucggccugaucuccaaaacuaaguacaacaaccuccugaccgaccccgaccacaucaacaaguacgagagcgcgggguucauccgccggcagcuggucgaaaccucccagauuaucaagcucgugagcaccauccugcaguccagauaccccaacacggagaucaucacugugaaggccaaguacaaucacuaccugcgcgagaaguucgaccucuacaagagccgggaggucaacgacuaccaccacgcgaucgacgccuaccuguccgccaucugcggcaaccugcucuaccagaacuaccccaaccugcgcccguucuucguguacgggcaguacaagaaguucagcucagaccccgacaaggagaaggagaucuucaacaagacccggaaguucagcuucaucucccagauccugaagaacaagagcgagaacagcaaggagaucgcggagaagcucaagcgcgccuaccaguuuaaguacaugcuggugucccgggagaccgagacgaaggaccaggagauguucaagaugaccgucuucccccgcgagacgcccggcaaucugaucccgaagaagaaggggauggccaccgagaucuacggcggcuacacgaagaacagcgacgccuacauggugaucgugaagaucgacaagaagaaggagaccgaguaccggauccucgggauacccacccgcgagcuggucaaccugaagaaggccgagaaggaggaccacuacgaguccuaccucaaggagauccucgcgccccggauccuguacaacaagaacggcaagcgcgacaagaagaucaccagcuucgagaucgugaaguccaagaucccguacaagcaggucauccaggacggggauaagaaguucaugcucggcagcuccacguacgucuacaacgccaagcagcugacccugagcaccgaguccaugaaggccaucaccaacaacuuugacaaggacagcgacgagaacgacgcucugaucaaggccuacgacgagauccuggacaagguggacaaguaccugccccucuucgacaucaaugcguuccggaagaagcugcacuccggccgcgagaaguucguggagcugagccucgaggacaagaaggacaucauccugaagguccugaucgggcuccacgauaaccccgccacguccgaccugaagacccugggguucagcuccaccgagcuagggaaaaugcagaagaacagcggcaucgugcuguccgggaacgccaagcugauuuaccagagccccaccggccucuucaagaaguccgugaagaucagcgaccuguga

SEQ ID NO: 7770 - RNA, 4113 nt, Artificial Sequence
  Cas9 variant
augaacaagcccuacagcaucggccuggauaucgggaccaacuccgugggcuggagcaucaucaccgacgacuacaaggucccggccaagaagaugcgcgugcucgggaacacggauaaggaguacaucaagaagaaccugaucggcgcccugcuguucgacgggggcaauacagcagccgaccgccgccugaagcggaccgcccgccggcgcuacacccggcgccggaaccgcauccuguaccuccaagagaucuucgccgaggagauguccaagguggacgacagcuucuuucaccggcuagaggacuccuuccuggucgaggaggacaagcgcggaagcaaauaccccaucuucgccacgaugcaggaggagaaguacuaccacgagaaguuucccaccaucuaccaucuccggaaggagcuugccgacaagaaggagaaagccgaccuacgccucaucuaccuagcccuggcccauaucaucaaguuccgggggcacuuccucaucgaggacgaccgauucgacgugcggaacacagacauccagaaacaguaccaggccuuccuggagaucuucgacaccacguucgagaacaaugaccuguugucccagaacguggacgucgaggccauccugaccgacaagaucagcaaguccgccaagaaagaccgcauccuggcccgguaccccaaccagaaguccaccggcaucuucgccgaguuccucaagcugaucguggggaaccaggccgacuucaaaaagcacuuuaaccuagaggacaagaccccgcuccaguucgccaaggacagcuacgacgaggaccuggagaaccuacucggccagaucggggacgaguucgccgaccuguucagcgccgccaagaagcuguacgacuccguguuacugagcggcauccugacggucacugacuuguccaccaaggcgccccugagcgcuuccaugauccaacgcuacgaugaacaccgcgaggaccugaagcagcucaagcaauuugugaaggcaagccugccggagaaguaccaggagaucuucgcagauucaagcaaggauggcuacgccggguacaucgagggcaagaccaaucaagaggcguucuacaaguaccugagcaagcuccugacgaagcaggagggguccgaguaccuacucgagaagaucaagaacgaggacuuucugcgcaaacagcgcaccuucgacaacggcagcauuccgcaccaggugcaccugacagagcuccgggccaucauccggcggcaguccgaguauuacccguuccucaaggaaaaccuggaccgcaucgagaagauacucaccuuccggauccccuacuacgugggcccucuggcucgcgagaaguccgacuucgccuggaugacgcggaagaccgacgacucuauccgccccuggaacuucgaggaccugguggacaaggagaaguccgccgaggcguucauucaccggaugaccaauaacgaccuguaccucccggaggagaagguucuucccaagcacagccuuaucuacgagaaguucacggucuacaacgagcucacgaaggugcgcuuccuggccgaaggguucaaggacuuccaguuccugaaccggaagcagaaggagaccaucuucaacagccucuucaaggagaaacgcaaagugaccgagaaggacaucauuucuuuccugaacaaggucgacggcuacgagggaaucgccaucaagggaaucgagaaacaguucaacgccagccuguccaccuaccacgaccuuaagaagauccuggggaaggacuuccuggauaacacggacaaugagcucauccuggaggacaucgugcagacccugacccucuucgaggaccgugagaugauccgcaagcgucuggauaucuacaaggacuucuucaccgagagccagcugaaaaagcucuaccgccggcacuacaccggcuggggacgucuguccgcgaagcugaucaacgggauccggaacaaagaaaaccagaagacgauccucgacuaccugaucgacgacggcagcgccaaccgcaacuucaugcagcugaucaaggacgccgggcucuccuucaagcccaucauagacaaggcccgcacgggcagccacuccgacaaucugaaggagguggucggggagcuggccggcagccccgcgauaaagaagggcauccuucaguccuuaaagaucguggacgagcuggugaaggucaugggguacgagccggagcagauuguggucgagauggcccgggaaaaccagaccacggccaaaggccucucucgcagccggcagcgccugaccacccugcgggagucccucgccaaucucaagagcaacauccuggaggagaagaagcccaaguacguaaaggaccagguggagaaccaccaccucuccgacgaccgccucuuccuguacuaccuccagaacgggaaggacauguauaccgacgacgagcuggacaucgacaaccugucgcaauacgacauugaccacaucaucccgcaggccuucaucaaggacgacagcaucgacaaccggguccucgugagcuccgcgaagaaccgcggcaagagcgacgacgugcccuccgucgagauagugaaggacugcaagguguucuggaagaagcugcuggacgccaagcucaugagccagcggaaauacgacaaccugaccaaggccgagcgcgggggccugacguccgacgacaaggcacgguucauccaacgccagcucgucgagacccgucagaucaccaaacacguggcccgcauccuggacgagcgguucaacaacgagcuggacagcaagggccgccggauccgcaaggugaagaucgucacccucaaguccaaccuggugagcaacuuccggaaggaguucggguucuauaagauccgcgaggugaacaacuaccaccacgcgcacgaugccuaccugaacgccguuguggccaaggcgauccucacgaaauacccgcagcuggagccagaguucguguacggcgacuacccuaaguacaauucuuacaagacgcgcaagagcgccaccgagaagcuguucuucuacuccaacaucaugaacuucuucaagacaaaagucacgcuagccgacgggaccgugguggucaaagacgacaucgaggugaacaacgacaccggagaaaucgugugggacaagaagaagcacuucgccacuguccggaagguacugagcuacccccaagugaacauagucaagaagacggagauccagaccggcggguucagcaaggagucuauccuggcccacgguaacagcgacaaguuaauaccgcgcaagaccaaggacaucuaccuggaccccaagaaguacgggggcuucgacucccccaagguggcguacagcgugcuggucguggccgauaucaagaaagggaaggcccagaaacugaagaccgugacggagcugcugggcaucaccaucauggagcgcucccgcuucgagaagaaccccagcgccuuccucgaguccaagggcuaccugaacauucgggacgacaagcugaugauccucccgaaguacagccuguucgagcuagagaacgggcgccggcgucuccuggccuccgcgggagaacugcagaagggcaacgagcucgcccugcccacccaauucaugaaguuccuguaccucgccagccgguacaacgagcugaagggcaagcccgaagagaucgagcagaaacaggaguucgucgugcagcacguguccuacuucgacgacauccugcagaucaucaacgacuucagcaaccgcgucauccucgccgacgccaaccuggagaagaucaacaagcuguaccaggacaacaaagagaacaucccuguggacgagcucgcgaacaacaucaucaaccucuucaccuucacgucccugggggcccccgccgccuucaaguuuuucgacaaaaucguggaccggaagcgcuacaccagcacgaaagagguccucaacuccacccugauacauaagagcaucaccggccuguacgagacccggaucgaccucggcaagcugggggaggacuga

SEQ ID NO: 7771 - RNA, 4113 nt, Artificial Sequence
  Cas9 variant
augaacaagcccuacagcaucggccuggacaucgggaccaacuccgugggcuggaguaucaucaccgacgacuacaagguuccggccaagaagaugcgcgugcucgggaacacggacaaggaguacaucaagaagaaccugaucggcgcccugcuguucgacgggggcaacaccgcugccgaccggcgccugaagcggaccgcccgccggcgcuacacccgacgcagaaaccgcauccuguaccuccaggagaucuucgccgaggagauguccaagguggacgacagcuucuuccaccggcuggaggacucuuuccuggucgaggaggacaagcgcggcagcaaguaccccaucuucgccacucuccaggaggagaaggacuaccacgagaaguucuccaccaucuaccaccuccggaaggagcuggcggacaaaaaggagaaggccgaucuccgccugauauacaucgcccuugcccacaucaucaaguuccgggggcacuuccucaucgaagaugauagcuucgacgugcgcaacaccgacaucuccaagcaguaucaggacuuccuggagaucuucaacaccacguucgagaacaacgaccugcucagccagaacguggacgucgaggcgauccugaccgacaagaucuccaagagcgccaagaaggaccggauccuggcccaguaccccaaccagaaguccaccggcaucuucgccgaguuccucaagcugaucguggggaaccaagccgacuucaagaaauacuucaaccuggaggacaagacgccccuccaguucgcgaaggacagcuacgacgaggaccuggagaaccugcucggccagaucggggacgaguucgccgaccuguucuccgccgccaaaaagcuguacgacagcgugcuccuguccggcauccugacggucaucgaccucagcaccaaggccccgcuguccgcgagcaugauccagcgcuacgacgagcaccgggaggaccugaagcaacucaagcaguucgugaaggccagcuugcccgagaaguaccaggagaucuucgccgacuccaguaaagacggcuacgccggguacaucgagggcaagacuaaccaggaggcauucuauaaguaccuguccaagcuccugaccaagcaggaggacagcgagaacuuccuggagaagaucaagaacgaggacuuccuccgcaagcagcggacguucgacaacggguccaucccccaccaggugcaccugaccgagcucaaggcgauuauccgccgccagagcgaguacuaccccuuccucaaggagaaccaggaccggaucgagaaaauccugacauuccgcauuccguacuacaucggcccccuggcccgggagaaguccgacuucgccuggaugacccgcaagacggacgacagcauccggcccuggaacuucgaagaccucgucgacaaggagaaguccgccgaggccuucauccaccgcaugaccaacaacgacuucuaccugcccgaggaaaaggugcugccgaagcacagccugaucuacgagaaguucaccguguacaacgagcucaccaagguccgguacaagaacgagcagggcgagacguacuuuuucgacuccaacaucaagcaggagaucuucgaugggguguucaaggagcaccgcaaggugagcaagaagaagcugcuggacuuccucgcgaaggaguacgaggaguuccguaucgucgacgugaucggccuggacaaggagaacaaagccuucaacgccucccuggggaccuaccacgaccucgagaagauccuggauaaggacuuccuggacaaccccgacaacgagagcauccucgaggacaucgugcaaacgcugacccuguucgaggaccgcgagaugaucaagaaacggcucgagaacuacaaggaccuguucacggagucccagcugaagaagcucuaccgccggcacuacaccggcugggggcgucugagcgccaaacugaucaacggcauccgggacaaggagucccagaagaccauccucgacuaccugaucgacgacgggcgcagcaaccggaacuucaugcagcugaucaaugacgacgggcucaguuucaagagcauaaucagcaaggcgcaggccggcucccacagcgacaaccugaaggaggucgugggggagcuggccggcucccccgccaucaagaaggggauccuccagagccugaagaucguggacgaguuagucaaggugaugggcuacgagcccgagcagaucgucguggagauggcccgcgagaaccagaccacgaaccagggccggcgcaacucccgccagcgguacaagcuccuugacgauggggugaaaaaccuggcgagcgacuuaaacggcaacauccugaaggaguacccgaccgacaaccaggcccugcagaacgagcgcuuauucuuguacuaccugcagaacgggcgggacauguacaccggcgaggcccucgacaucgacaaccugucccaguacgacaucgaccacaucauuccccaggccuucaucaaggacgacagcaucgacaaccgcguccugguguccagcgccaagaaccgggggaaguccgacgacgugcccagccucgagaucgucaaggacugcaagguguucuggaagaagcugcuggacgcgaagcucaugucccagcgcaaguaugacaaccugacaaaggccgagcggggcggccugacgagcgacgacaaggcccgcuucauccagcggcagcucguggagacccgccagaucaccaagcacgucgcccggauccuggacgagcgcuuuaacaacgagcuggacuccaaggggcggcgcauccggaaggugaagaucgugacccucaagagcaaccugguuuccaacuuccgcaaggaguucggcuucuacaagauccgcgaggugaacaacuaccaccacgcccacgacgcguaccugaacgccguggucgccaaggccauccucaccaaguacccccaacuggagccggaguucguguacggggacuaccccaaguacaacagcuacaagacgcgcaaguccgcgacugagaagcuguucuucuacuccaacaucaugaacuucuucaagaccaaggugacgcucgccgacggcacggucguggugaaggacgacauugagguaaacaacgacaccggcgagaucgugugggacaagaagaagcacuucgccaccgugcggaagguccugagcuacccccagaacaacaucgugaagaagaccgagauccagaccgggggcuucuccaaagagagcauccuggcucacgggaacuccgacaagcuaaucccccgcaagaccaaggacaucuaccuggacccgaagaaguacggcggguucgacagccccaucguggccuacuccguccuggugguggcggacaucaagaagggcaaggcccagaagcucaagacuguaaccgagcugcugggcaucacuaucauggagcggagccgcuucgagaagaaccccuccgccuuccucgagagcaagggguaccugaacauccgcgccgacaagcugaucauccuccccaaguacucccuguucgagcuggagaacggccggcgccggcuccuggccagcgcgggggagcugcagaagggcaacgagcucgcccugccgacccaguucaugaaguuccuguaccucgccucccgcuacaacgagagcaaggggaagcccgaggagaucgagaagaagcaagaguuugugaaccagcacguguccuacuucgacgacauccugcagcugaucaacgacuucagcaagcgcgucauccucgccgacgccaaccuggagaagaucaacaagcuguaccaggacaacaaggagaacaucuccguggacgagcucgcaaacaacaucaucaaccuguucaccuucaccagccugggcgcccccgccgccuucaaguucuucgacaagaucguggaccgcaagcgguacacguccaccaaggagguccucaacagcacccugauccaccaaagcauaaccggccuguaugagacgcgcaucgaccucgggaagcugggcgaggacuga

SEQ ID NO: 7772 - RNA, 4113 nt, Artificial Sequence
  Cas9 variant
augaacaagcccuacagcaucggccuggacaucgggaccaacuccgugggcuggagcaucauaaccgaugauuacaaggucccggccaagaagaugcgcgugcuugggaacaccgacaaggaguacaucaagaagaaccugaucggcgcgcugcuguucgacggcgggaacaccgcggccgacagacgccugaagcggaccgcccgacggcgguacacccggcgccggaaccgcauccuguaccuccaggagaucuucgccgaagagauguccaagguggacgacagcuucuuccaccggcuggaggacuccuuccuggucgaggaggacaagcgcgggagcaaguaccccaucuucgccacgcuucaggaggagaaggacuaucacgagaaguucagcaccaucuaccaccuccggaaggagcuggcggacaagaaagaaaaggccgaccuccgccugaucuacaucgcccuggcccacauaauaaaguuccgggggcacuuccucaucgaggacgacagcuuugacguccgcaauaccgacaucuccaagcaguaccaggacuucuuggagauuuucaacaccacguucgagaacaacgaccugcucucccagaacguagacguagaagcuauccugaccgacaaaauuuccaagagcgccaagaaggaccggauccuggcccaguacccaaaccaaaaguccaccggcaucuucgccgaguuccucaaacugaucguggggaaccaggccgacuucaagaaguacuuuaaccuggaggacaagacgccacuccaguucgcgaaggacuccuacgacgaggaucuggagaaucugcucggccagaucggggacgaguucgccgacuuguucuccgccgccaagaagcuguacgacagcgugcuccugaguggcauccugacgguuaucgaccucagcaccaaggccccguuauccgcgagcaugauacagcgcuaugacgagcaccgggaggaccucaagcagcucaagcaguucgugaaggccagcuuacccgagaaguaccaggagaucuuugccgacaguagcaaggacggcuacgccggauacaucgagggcaagacuaaccaggaggccuucuacaaguaucuguccaagcuccugacaaagcaggaggacucagagaauuuccuggagaagaucaagaacgaggacuuucuccgcaagcagcggacguucgacaacggauccaucccccaccaggugcaccuaaccgagcugaaggcgauaauccgcaggcagagcgaguacuaccccuuccucaaggagaaccaggaucggaucgagaagaucuugaccuuccgcaucccguacuacaucggcccccuggcccgggaaaaguccgacuucgccuggaugacucgcaaaacggacgacagcauucggcccuggaacuucgaggaccucgucgacaaggaaaaguccgccgaggcguuuauccaccgcaugaccaacaacgacuucuaccugcccgaggagaaagugcugccaaagcauagccugaucuacgagaaguucaccgucuacaacgaacucaccaagguccgguacaagaacgagcagggcgagacguacuucuucgacuccaacaucaagcaggagaucuucgacgggguauucaaggagcaucgcaaggugagcaagaagaagcuguuggacuuccucgcgaaggaguacgaggaguuccggaucgucgacgugaucggccuggacaaggagaacaaggccuucaacgcgucccuggggacauaccacgaccucgaaaagauccuggacaaggacuuccuggacaacccugacaacgagagcauacucgaggacaucgugcagacccugacccuguucgaggacagagaaaugaucaagaagagacucgagaauuacaaggaccuguucacggagucucagcugaagaagcucuaucgcagacacuacaccggcugggggcgccuaagcgccaaacugaucaacggcaucagggacaaagagucccagaagaccauccucgacuaccugaucgacgauggccggagcaaccggaacuucaugcagcugaucaacgacgacgggcuauccuucaaaagcaucaucagcaaggcgcaggccggcucucauagcgacaaccugaaggaggucgucggggaguuggccggcuccccagccauaaagaaggggauccuccaaagccuaaagaucguggacgaacuggucaaggugaugggcuacgagcccgagcagaucgucguggagauggcccgcgagaaccagaccacgaaccaaggccggcgcaacucacgccagagauacaagcuccuggacgacggggugaagaaccuggcgagcgaccucaacgggaacauacugaaagaguacccuaccgacaaccaggcccugcagaacgagcgccucuuccuguacuaccugcaaaaugggcgggacauguacaccggcgaggcgcucgacaucgacaaccugucccaauacgacaucgaccacaucaucccucaggccuucaucaaggacgacagcauagacaacagaguccugguguccagcgccaagaaucgggguaaguccgacgacgugcccagccucgagaucguuaaggacugcaagguguucuggaagaaguuacuggacgcgaaacucaugucccagcgaaaguacgacaaccugaccaaggccgagcggggcggccucacuagcgacgauaaggcccgcuucauccagcggcagcucguggagacccgccagaucacgaagcacgucgcccggauccuggacgagcgcuucaacaacgagcuggacuccaagggccggcggauccggaagguuaagauugugacccucaagagcaaucuggucuccaacuuccgcaaggaguucgguuuuuacaaaauccgggaggugaauaacuaccaccacgcgcacgacgcguaccugaaugccguggucgccaaggccauccucacaaaguacccccagcuggagcccgaguucguguacggggacuaccccaaguacaauagcuacaagacgcgcaagagcgcgacggaaaagcuguucuucuacuccaacaucaugaacuucuucaagacaaagguuacucucgccgacggaacggucgugguuaaggacgacaucgaggucaacaacgacaccggcgagaucguuugggacaagaagaagcacuuugcaaccgugaggaagguucugagcuauccccagaacaacaucguuaagaagaccgaaauccagaccgggggauucuccaaggagagcauacucgcccacgggaacuccgacaagcucauaccccgcaagaccaaggacaucuaccuggacccgaagaaguacggcggguucgacagccccaucguggccuacagcguccuagugguggcugacaucaaaaagggcaaggcccaaaaacucaagacggucaccgaguugcugggcaucacgaucauggagcggagccgcuuugagaagaaucccuccgcauuccucgagagcaagggguaccugaacauccgggacgacaagcugaugauccuccccaaguacucccuguucgagcuggagaacggccggcgccggcuccuagccagcgccggggaguuacagaaggguaacgagcucgcauuaccgacccaguucaugaaauucuuauaccucgccucccgcuacaacgagagcaaagggaagcccgaggagauagagaaaaagcaggaguucgugaaccagcacguguccuacuucgacgacauccugcagcugaucaacgacuucagcaagcgggucauucuugccgacgccaacuuagagaagaucaacaagcuguaccaagacaauaaggaaaacaucuccguggacgagcucgccaauaacauuaucaacuuguucaccuucaccagccugggggcgcccgccgccuuuaaguucuucgacaagaucguggaccgcaagcgcuauacguccaccaaggagguccucaacagcacccuaauccaccagagcaucaccggacuguacgagacgaggaucgaccuagggaagcugggugaggacuga

SEQ ID NO: 7773 - RNA, 4113 nt, Artificial Sequence
  Cas9 variant
augaacaagcccuauagcaucggccuggacaucgggaccaacuccgugggcuggagcaucaucaccgacgacuacaaggucccggccaagaagaugcgcgugcuagggaacacggacaaggaguacaucaagaagaaccugaucggcgcccuccucuucgacgggggcaacaccgcggccgaccggcgccugaagcggaccgcccgccgucgcuacacccggcgccggaaccgcauccuguaccuccaggagaucuucgccgaggagauguccaagguggacgacagcuucuuccaccggcuagaggacuccuuccuggucgaggaggacaagcgcggcagcaaauaccccaucuucgccacgaugcaggaagagaaguacuaccacgagaaguuccccaccauuuaccaccuccggaaggaacuggcggacaagaaggagaaggcugaccugcgccucauauaccuggcccuggcccacaucaucaaguuccgggggcacuuccucaucgaggacgaccgcuucgacgugcggaacaccgacauucagaagcaguaccaggcguuccuggagaucuucgacaccacauucgagaacaacgaccugcucucccaaaacguggacgucgaggccauccugaccgacaagaucagcaaguccgccaagaaggaccgcauccuggcccgguacccgaaccagaaguccaccggcaucuucgccgaguuccucaagcugaucguggggaaccaggcggacuucaagaagcacuucaaccuggaggacaagaccccgcuccaguucgccaaggacagcuacgacgaagaccuggagaaccugcucggccagaucggggacgaguucgccgaccuguucagcgccgccaagaagcuguacgacuccgugcuccugagcggcauccugacggucaccgaccuauccaccaaggcgccccugagcgccuccaugauccagcgcuacgacgagcaccgggaggaccugaagcagcucaagcaguucgugaaggccagccugcccgagaaguaccaggagaucuucgccgacuccagcaaggacggcuacgccggguacaucgaagggaagaccaaccaggaggcguucuacaaguaccugagcaagcuccugacgaagcaggagggguccgaguaccugcucgagaagaucaagaacgaggacuuccugcgcaagcagcgcaccuucgacaacggcagcaucccccaccaggugcaccugaccgagcuccgggccaucauacgccggcaguccgaguacuacccacugcugaaggagaaccucgaccgcauugagaagauccugaccuuccggauccccuacuacgucggcccccuggcccgagagaaguccgacuucgccuggaugacgcguaagaccgacgacagcauccgccccuggaacuucgaggaccugguggacaaggagaaguccgccgaggcguucauccaccggaugaccaacaacgaccucuaccugccggaggagaaggugcugcccaagcacagccucaucuacgagaaguucaccgucuacaacgagcucacgaaggugcgcuuccuggccgagggguucaaggacuuccaguuccucaaccggaagcagaaggagaccaucuucaacagccuuuucaaggagaagcgcaaggugaccgaaaaggacaucaucuccuuccugaacaaggucgacggcuacgagggaaucgccaucaagggcaucgagaagcaauucaacgccagccucuccaccuaccacgaccugaaaaagauccuagggaaggacuuccucgacaacacggacaacgagcugauccuggaggacauugugcagacccucacccuguucgaggaccgggagaugauccgcaagcggcuggacaucuauaaggacuuuuucaccgagagccagcucaagaagcuguaucgccgccacuacacggguuggggccgccuuuccgcgaagcucaucaacgggauccggaacaaggagaaccagaaaaccauccuggacuaucugaucgacgacggcagcgccaaccgcaacuucaugcagcucaucaaggacgccgggcuguccuucaagcccaucaucgacaaggcccgcaccggcagccauuccgacaaccugaaggagguggucggggagcucgccggcagccccgcgaucaagaagggcauccugcagucccugaagaucguagacgagcucgugaaggucaugggguacgagccggagcaaaucguggucgagauggcccgggagaaccagaccacggcuaagggccugagccgcagccgccagcgccucaccacacuccgggagucccuggccaaccucaagagcaauauauuagaagagaagaagcccaaguacgugaaggaccagguggagaaccaccaccuguccgacgaccgccuguuccucuacuaccugcagaacgggaaggacauguacaccgacgacgagcuggacaucgacaaccucagccaauacgacaucgaccacaucaucccccaggccuucaucaaggacgacucuaucgacaaccgggucuuagugagcuccgcuaagaaccgcggcaagagcgacgacgugcccuccgucgaaaucgugaaggacugcaaggucuucuggaagaagcugcucgacgccaagcugaugagccagcggaaguacgacaaccugaccaaggccgagcgcgggggacucacguccgaugacaaagcccgguucauccagcgccagcuggucgagacccggcagaucaccaagcacguggcccgcauccuggacgagcgguucaacaacgagcucgacagcaagggucgccggauccgcaaggugaagaucgucacccugaaguccaaccuggugagcaacuuucggaaggaguucggguucuacaagauccgcgaggugaacaacuaccaccacgcgcacgacgccuaccucaacgccguuguggccaaggcgauccugacgaaguacccgcaacuggagcccgaguucguauacggcgacuaccccaaguacaacuccuacaagacccgcaagagcgcaacggagaagcuguucuucuacuccaacaucaugaacuucuucaagaccaaggucacgcuggccgacgggaccgugguggucaaggacgacaucgaggugaacaacgacaccggcgagauugugugggacaagaagaagcacuucgccaccguccggaaagugcugagcuacccccaggugaacauagucaagaagacggagauccagaccggcggguucagcaaggaguccauacucgcccacggcaacagcgacaagcugaucccgcgcaaaaccaaggacaucuaccuggaccccaagaaguacgggggcuucgacucccccaucguggcguacagcgugcucgucgucgccgacaucaagaaggggaaggcccagaagcugaagaccgugacggaacugcucggcaucaccaucauggagcggucccgcuuugagaagaaccccagcgccuuccuggaguccaagggcuaccuggacauccgugaugacaagcucaugauccugccgaaguacagccuguucgagcucgagaacgggcgccggcgccugcuggccuccgcgggcgagcuccagaaggggaacgagcuggcccugcccacccaguucaugaaguuccucuaccuggccagccgguacaacgagcugaagggcaagcccgaggagaucgagcagaagcaggaguucgucgugcagcacguguccuacuucgacgacauccuccagaucaucaacgacuucagcaaccgcgucauccuggccgacgccaaccuggagaagaucaacaagcucuaccaggacaacaaagagaacauuccggucgacgagcuggcgaacaacaucaucaaccuguucaccuucacgucccucggggcccccgccgccuucaaguucuucgacaagaucguugaccggaagcgcuacaccucaaccaaggagguccugaacuccacccugauccaccagagcaucacgggccucuacgagacccggaucgaccugggcaagcugggggaggacuga

SEQ ID NO: 7774 - RNA, 4113 nt, Artificial Sequence
  Cas9 variant
augaagaagcccuacagcaucggccuggacaucgggaccaacuccgugggcugggccgucgugaccgacgacuacaaggugccggccaagaagaugcgcgucuucggggacacugaccggagccacaucaagaagaaccuccugggcacccuccucuucgacgacggcaacaccgcggagucccgccgguugaagcgcaccgcccggcgccgguacacgcgccggcgcaaccgaauccuguaccuccaggagaucuucaccgagagcaugaacgagaucgacgaguccuucuuccaccgccuggacgacagcuuccuggugcccgaggacaagcggggguccaaguaccccauuuuugccacccuccaggaagagaaggaguaccacaagcaguuucccaccaucuaccaccuccgcaagcagcuggccgacagcaaggagaaguccgacgugcggcucaucuaccuggcccuggcgcacaugaucaaguaccgcggccacuuccuguacgaggagacguucgacaucaaaaacaacgacauccagaagaucuucaacgaguucaucaacaucuacgacaacacuuucgaggggagcucccugagcggccagaacgcccaggucgaggccaucuucaccgacaagaucuccaagucagccaagcgggagcgcgugcugaagcuguucccggacgagaaguccaccgggcuguucagcgaguuccugaagcugauugugggcaaccaggcggacuucaagaagcacuuugaucuggaggagaaggcaccgcugcaguucuccaaggacacguacgacgaggagcucgagaaccugcuggggcagaucggcgacgacuucgccgaccucuuccugaucgcaaagaagcuguacgaugccauccuccugagcggcauccugaccgucaccgaucccuccaccaaggcgccccucagcgccucuaugaucgagcgguacgagaaccaccagaaggaccuggccgcccugaagcaguucaucaagaacaaccucccggagaaguacguggagguguucucagaccagagcaaggacggguacgccggcuacaucgacgggaagacgacccaggaggcguucuacaaguacaucaagaaccugcuguccaaguucgagggcgccgacuacuuccucgacaagaucgagcgcgaggacuuccugcggaagcagcgcaccuucgacaacggcagcaucccccaccagauccaccuccaggagaugaacgccauccugcgccggcagggggagcacuaccccuucuugaaggagaaccgcgagaagaucgagaagauccugaccuuccggauccccuacuacgucggcccgcucgcccgcgacaacagagacuucuccuggcugacgcgcaacagcgacgagcccauccggcccuggaacuucgaggaagugguggacaaggcccgcuccgcggaggacuucauccaccggaugaccaacuaugaccuguaccuccccgaggagaagguccugccgaagcauagccugcuguacgagaccuucgccguguacaacgagcucaccaaggugaaauucaucgcggaggggcugcgcgacuaccaguuccuggacuccggccagaagaagcagaucgucaaccagcuguucaaggagaagcggaaggugacggagaaggacaucauucacuaccugcacaacguggacggguaugacggcaucgagcugaagggcaucgaaaagcaguucaacgccaaccucagcaccuaccacgaccugcugaagaucaccaaggacaaggaguucauggacgaccccaagaacgaggagauccucgagaacaucguccauacccugacaauauucgaggacagagagaugaucaagcagcggcuggcccaguacgacacccucuucgacgaaaaggugauuaaggcgcugacccgccggcacuacaccggguggggcaagcuguccgccaagcucaucaacgggauccgcgacaagcagagcggcaaaacgauccuggacuaccugaucgacgacgacaagaucaaccggaacuucaugcagcucaucaacgacgacgggcuguccuucaaggagaucauccagaaggcccagguggucggcaagaccgacgacgugaagcaggucgugcaggagcuccccggcagccccgccaucaagaaggggauccuccaguccaucaagaucguggacgaacuggucaaggugaugggcuacgcgcuggagagcauagugaucgagauggcccgcgagaaccagaccaccgcccgggggaagaagaacucccagcagcgcuacaaacgcaucgaggacgcccucaagaaccuggccccgggccuggacagcaacauccucaaggagaaucccacggacaacauccaguuaaagaacgaccggcuguuccucuacuaccugcagaacgggaaggacauguacaccggcaagccccuggacaucaaccagcucuccagcuacgacaucgaccacaucaucccccaggcguucaucaaggacgacagcaucgacaaccgcguccugaccuccagcaaggacaaccggggcaaguccgacaacgugccgagccuggagguaguccagaagcgcaaggccuuuuggcagcagcugcuggauuccaagcugaucagcgagcggaaguucaacaaccucaccaaggccgagcgcgggggccuggaugagcgggacaaggugggguucauccgccggcagcugguggagacccagcagaucacgaagaacgucgcccagauccucgacgcccgcuucaacaccgaggugaaggagaagaaccagaagauccggaccgugaagaucaucacccugaaguccaaccuggucagcaacuuccgcaaggaguucggccucuacaaggugcgggagaucaacaacuaccaccacgcgcacgacgccuaccugaacgcuguggucgccaaggccauccugaagaaauaccccaagcucgagcccgaguucgucuacggcgacuaccagaaguacgaccugaagaaguacaucucccgcuucaagcccagcaaggagaucgagaaggccacggagaaguacuucuucuacuccaaccugcucaacuucuucaaggaggagguucucuacgccgacggaaccauccggaagcgcgagaacaucgaguacagcaaggacacgggcgagaucgccugggacaaggagaaggacuucgccaccaucaagaagguccuguccuacccccaggugaacaucgugaagaagcgggagguccagaccgggggcuucagcaaggagucaauccuccccaaggggaacagcgacaagcugaucccccgcaagacgaaggacauccugugggacaccaccaaguacggcggcuuugacuccccggugaucgcguacagcauccuccugaucgccgacaucgagaaggggaaggccaagaagcugaagacggugaagacccucgucggcaucaccaucauggagaaggccgccuucgaggagaaccccaucaccuuccuggagaacaagggguaccacaacgugcggaaggagaacauccugugccuccccaaguacagccuguucgagcuggagaacggcagacggcgccuccuggcguccgccaaggagcugcagaaggggaacgagaucguccuccccgucugccugacgacccuguuguaccacagcaagaaccugcacaagcuggacgagcccgagcaccucgaguacauccagaagcaccgcaacgaguucaaggaccugcugaaccucguguccgaguucagccagaaguacauccuggccgaggccaaccuggagaagaucaaggaccucuacgcugacaaugagcaggcggacaucgagauccuggccaacuccuucaucaaccuccucacguucaccgcccugggcgcccccgccgcguucaaguucuucggcaaggacguggaccggaagcgcuacacgaccgucagcgaaaucuuaaacgccacccucauccaccagagcaucacggggcuguacgagacgcggaucgaccugagcaagcucggcgaggaguga

SEQ ID NO: 7775 - RNA, 4113 nt, Artificial Sequence; identical to SEQ ID NO: 1975
  Cas9 variant

SEQ ID NO: 7776 - RNA, 4113 nt, Artificial Sequence
  Cas9 variant
augaauaagcccuacagcaucggccuggacauugguacgaacuccgugggcuggagcaucauaaccgaugauuacaagguaccggccaagaagaugcgugugcucgggaacacagauaaggaguacaucaagaagaaucugauaggggcacuccuguucgauggaggaaacaccgcugcugaccgacgccugaagcggaccgccagacggagguacacccggcgccggaaccgcauccuguaccugcaggagauuuucgccgaggagaugagcaagguggacgacagcuucuuccacaggcuggaggauuccuucuuagucgaggaggacaagcguggcuccaaguaucccaucuucgccacgaugcaagaggagaaguacuaccacgagaaguuucccaccaucuaccaucuccggaaggaacuggcggacaagaaggagaaagccgaccugcgccugaucuaccuggcccuggcccacauuaucaaguuccgggggcacuuucucauagaggacgaccgcuuugacguccggaacaccgacauccagaagcaguaucaggcauuccuggagaucuucgacaccacuuucgagaacaacgaucuccugucccagaacgucgacgucgaagccauccugaccgacaagauuagcaaguccgccaagaaggaccgcaucuuggcccgguacccgaaccagaaauccacuggcaucuucgccgaguuccucaagcugauaguggggaaucaagcggacuucaagaagcacuucaaccuggaggacaagacuccgcugcaguucgccaaggacagcuacgacgaagaccuggaaaaucuacucggccagaucggugacgaguucgccgaccuguucagcgccgccaagaaacuguacgacuccgugcucuugagcggcauccugacggucaccgacuuguccaccaaggcgccccuuucugccagcaugauccagcgcuacgaugagcaucgggaagaccugaagcagcucaagcaguucgugaaggcaagccuucccgaaaaguaccaggagauauucgccgacuccagcaaggacggcuacgccggguacauagagggcaagaccaaccaggaggcauucuauaaguaccugagcaagcuccugacgaagcaggagggguccgaguaccugcucgaaaagaucaaaaaugaagacuuccugcgcaagcagcgcaccuucgacaacgggaguaucccccaccaggugcaucuaaccgagcuccgggccaucauucgccgccaguccgaauacuacccguuucugaaggagaacuuagaccgcaucgagaagauccucacuuuccggauccccuauuacgucggcccccuggcacgcgaaaagucagacuucgccuggaugacgcggaagaccgacgacagcauucgccccuggaacuucgaagaccugguggacaaggagaaguccgccgaggcguucauccaccggaugaccaacaacgacuuauaucucccagaggagaagguucuccccaaacacucucugaucuacgagaaguuuaccgucuacaacgaguugacuaaggucagguuccuggccgagggguucaaagauuuccaguuucugaacaggaagcaaaaggagaccaucuucaauagccuguucaaggagaagcgcaaggugaccgagaaggacaucauuuccuuccugaauaaagucgacggcuacgaggggaucgccaucaagggcauugagaaacaguucaacgccucccuguccacuuaccacgaccucaagaagauccugggcaaggacuuucuggacaauacggauaacgagcucauucuggaagacaucgugcagacccugacacucuucgaggaccgggagaugauccgcaagcggcuggacaucuacaaggauuucuucaccgagagccagcugaagaaacucuaucgccggcacuacacgggcuggggccggcuaucugcgaagcugaucaacgggauccggaacaaggagaaccagaagacaaucuuggacuaccuuaucgacgacggaagcgccaaccgcaacuuuaugcagcugaucaaagacgccggccucuccuucaagcccaucauagacaaggcccggaccggcagccacuccgacaaucugaaggagguggugggugagcuggccggcagccccgcgaucaagaagggcauauuacagucccuaaagaucguggacgagcuggugaagguaaugggguacgagccggagcagaucguggucgaaauggcccgggagaaccaaaccaccgccaagggccucagccgcuugcggcaacgcuugacuacccucagggagagccuggccaaccugaaguccaacauacucgaggagaagaagcccaaguacgugaaggaccaaguggagaaccaccacuuaagcgacgaccgccuguuccucuauuaccugcagaacgggaaggacauguacaccgacgacgagcuggacaucgacaaccuuagccaguacgacaucgaccacaucaucccccaagccuucauaaaggacgacagcaucgacaaucggguacuggugucuagugcuaagaaucgcggcaaguccgacgauguucccagcgucgagauuguuaaggacugcaaggucuucuggaagaagcugcucgacgccaaacugaugucccagagaaaguaugacaaccugaccaaggccgaacgagggggccucacgagcgacgacaaggcccgguucauccagcgccagcuggucgagacccggcagaucaccaagcacguagcccgcauccuggacgagcgguuuaacaacgaacucgacucaaaaggccgcagaauccgcaaaguuaaaaucgucacccucaagucgaaccugguguccaacuuccggaaggaguucggauucuacaagauccgcgaggugaacaacuaccaccacgcgcaugacgccuaccuuaacgccgucguggccaaggcgauacugacgaaguacccgcagcuggagccugaguuuguuuauggcgacuaccccaaguacaacagcuacaagacaagaaaguccgccacagagaaacuguucuucuacagcaacaucaugaacuucuucaagaccaaggucacgcuggccgacgggaccgucguggucaaggacgacaucgagguuaacaacgacaccggcgagaucgugugggacaagaagaagcacuucgcaaccguccgcaaagugcuguccuacccacaggugaacaucgucaagaagacggagauacagaccggcggguuuagcaaagagagcauccucgcccacggcaauuccgacaagcugaucccgcgcaagaccaaggacaucuaccucgaccccaagaaauaugggggcuucgacagccccaucguugccuacuccgugcucgucguugccgacaucaaaaagggaaaggcccagaagcugaagaccgugacggagcuccucggcauaacuaucauggaacggucccgcuucgagaaaaaccccuccgccuuccuggagagcaagggcuaccugaacauccgugaugacaaacucaugaucuuaccgaaguacucccuguucgagcucgagaacggccgccgacgacugcucgccagcgcggacgagcuccagaaggguaacgaacucgccuuaccgacccaauucaugaaguuucucuaccuggccucccguuacaacgagcugaaggggaagcccgaggaaaucgagcagaagcaagaguucguggugcagcacgugagcuacuucgacgauauacuccagauaaucaacgauuucuccaaccgcgugauccuggcagacgccaaccuggagaagaucaacaagcucuaccaggacaacaaggaaaacaucccgguggacgaguuggcuaacaacaucaucaaccuguucacguucacgucacucggcgcccccgccgccuucaaguucuucgacaagauaguggaccggaagcgcuacaccuccaccaaggaaguacuuaacagcacccugauccaucaguccaucacggggcucuacgagacucggaucgaccuaggcaaguugggugaggacuga

SEQ ID NO: 7777 - RNA, 4113 nt, Artificial Sequence
  Cas9 variant
auggagaagaacaaggaauaugugaucggccuggacaucgguacuggcagcguuggaugguccgccaucagcacggauaacuaccagcugauacgccagaagggaaagaaccugaucggggugcggcuguucaacuccgccgagacggcggaagaacggcggggcuaccgcaccacccggcgccggcucagccgccggcgcuggcggaugagucugcugaacgacaucuuccgcccagagcucaacgagaucgaugagaacuuccuggcccggcucaaguacagcuggguguccccgcucgaccagaagaacccccagcugaacgagcagggcaccaacgccagccucuacggggacaucgaggccgaucaagccuuccaccgcgcguacccgacgaucuaccaccuccggaagacccugauggaggacaaccagaagcacgaccugcgcgaggucuaccucgccauacaccacaucgugaaguaucggggccacuuccugacccccgacuuugacgccaacucccaaaccaucgacaucaagggucuguucaagcagcucggcgacgugagcggguccaucgagcugcaggccgaccagacgagcaccgucaucgcggcuuuccaguccauccuguuggacuucaccaagaccccgacagagagcgggcgccuggccggccaacuguucuccgaucagaacaaggacaagcaggccaagaaacaggucgaggagcuguucaagcuccugcgugguggcaagggcagccucgccgacauguuccugcugaccgaccucgacaagguggugaagaaccagcugaaguucgcguucgacgacgccguagacgagaaccugaacuugaucuccaaccugauuaaugaggaacaguacgagcugcuccugaacauccagaaacuucggggcaccaucauccucaaacagauccugggugacgaugagaccgugagcgacgccaagguccgauccuacgaggagcacgcccaccagcugaaggagcucaaggcccaagugcugacgaaggacaacaaagagaaguucgaagaagccuaccagcugauccaaaagggagacgccagcaggaucgacggucucaaaaagcugaaaaccauaauaaaccaggaacacgaggcgcugcgccucgacaaguacgaggcggauaagcugcugaagcugaucgagcucgaccagcugcugcccgugcagcgcagcaagcgcaacggggagaucccccaccaguugcacgaguucgagcugaagaagaucaucgagaagcagggccgguacuaccccuuccugcgcgagaccuucgaacgggacgggcaggaguucaacaagaucggccagcuugucaacuuccgcaucccguacuacgugggcccccugguugacccccggcuggccgguauccagucaggcgaccaaaccaaccacuggaugacgcaaaagaaggcagggaagauuacccccuggaauuacaccgagcucaucgacaucgacaagagcgccgccgaguucaucaagcgcaugaccgggacggacaccuaccuagucggggagccgucucuucacaaggccagccucaucuaccaggacuacaacgugcugcaggagcugaacaaucugcgguacgaugggaagcccuugccaguggacgccaagcaggagaucuacuccaaccugcaggucagccucaaaaacgcgaccaagaauaagauaaacaguuuccuaaucagcgagggcuaccugcaggacggggaggagcucaccggcuucgcugggaaggagcugaaaaacaagcugagcucguuccacuauuucaagaacaucuuuggccccgaacgcaugaacacgcucgggacggauaaccuggagaaaauaaccgagcugcagaccguguucgaggaccggcacaugcucaagaggcagcugcagaaacuaggcuuccuggaugacgacgagugcgagaaacuggcaggcaaacacuucacggguuggggcaaucuguccaagaagcuccugaacaccccggccaucaucgaccccgagaucaacgagaacaagaucagccugaucgacgcgcucuauaaggggcagcggaaccuguccuucuacgugaacaauauggacgacaaguaucaguuccgcgacuggaucgagagcgagaaccagucccaacaggucgagauuagccuagacgagaagaucaagaaucucgcaggcucccccgccaucaagcggggcaucacccaguccauggccgugauccaggacaucauccgcgccaacaacgggauuucccccaagcggaucuaccuggaguucgcgcgcgagagccagaacagcuaccagccgaacucccgcaucaagcagaucgagaagaucuacgaccagaacaagaaggagcugaugaaggucuacccugacguguucaaggacgugcagggcguccugaacaacguggacgagaacaacagccugucagagaaggccuuccuuuauuucaugcaacucgggaaggacauguacaccggcgaggcuuuggauuucgacaaacuuuacacguacgacaucgaccacaucauaccccaggccaugaccaaggacaacagcugggacaacaaggugcucgucaccgccaucaagaaccgcgagaaguccaaccaggugcuagauaacgcuauccaggccaagaugcacaacuucuggcuacagcucaagaaggugaaucugcugucccagagaaaguacgacacccucaugaaaaccaauuucuccaagggagacgagaagaaguucauagccagaucgcuggucgagacacgccagauaaucaagaacguugccgagcugaucaaguccgaguucgaccacguggaggcgauuccgauccgccaggagcuaacgucggacaugagacagcugauggacuacaagaagaaccgccuggucaacgacuaccaucacgcgcaugacgcccuccugauagccacagugggagaguuuaugcagaagcgcgguuucaugcaggggaugaacccgucccagaacguauaccacggcuacacacaauacgucaagaaguggcuuuccauggccaagaaagcgagauccgccgagaagccagagcgaaucuucccccuccaguucgugguggggagcaugcgcauggccguccgcgacggccagguggacaaagugacgcacccugcaaccggggaaaucugcuggacagcugacaacgaggcguaccuacgaaagguccugggcuacaagaacauccucgugacgcgcaaggugaagaacgcuggcaagcuguaccagagaguaacagugaagccgaagggguccggcgaggccccggugaaccaccaaaaguccgacauaaacaucuacgggggcgugaccuccgagcaggccgcggagcuggugcucauccgcaucaaggcgaagaauaacgccaagaacauggugaucaagauccccaccgccauagccaaucagguugccaacaagaccacgaccuacgacgcguacguccggagucugaacaucccgaauuacgccggaauaauccuggaucagaucccucucggacagcugguguucgacgagagaaccagcuucuaccuggccuccgccgagauuaagcacaacgcgcggcagcucugggucaaccagcacaucaauaacgugcugaccaagaagaacaucaacgacgaggagcgugacaauauccugaaccucuuaacgaaugagaagaaccuggagcgguucaagcugcuggagcccgacuugaagcgcgugaaggcggccaagcagcagugggccaguugcgacgaccaggagcagaugcagauccuccggaucaucaucaacaagaugcacgacgaugccaguccccagaucccgggaaagaucgaccccuucaagaacuaccuggacaagcaggggaagggcuggcgcgaccugcgcaccaagaagggaaugaagcucuccgauaacgcggaguucgucuaccagucaccgacaggccuguaccaccggaagaucagcaucaacgagcugcucaagcagaagcagcuggaguga

SEQ ID NO: 7778 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaauacggacaaggaguacaucaaaaagaaccugaucggcgcccugcuguucgacgggggcaacaccgcggccgaccggcgccugaaacggaccgcccgccggcgcuacacccggcgccggaaccgcauccuguacuuacaggagaucuucgccgaggagaugucuaagguggacgacagcuucuuccacagacuggaggacuccuuccuggucgaggaggacaagcgcggcagcaaguaccccaucuucgcuacgaugcaggaggagaaguacuaccacgagaaguuccccaccauuuaccaccuccggaaggagcucgcggacaagaaagagaaggcggaccugcgcuugaucuaccuggcccuggcccacauaaucaaguuccgggggcacuuccucaucgaggacgaucgcuucgacgugcggaacaccgacauccagaagcaguaccaggcauuccuggagaucuucgacaccacguucgagaacaacgaccugcucucgcagaauguggacgucgaggccauccugaccgacaagaucucuaaguccgccaagaaagaccgcauccuggcccgguaccccaaccagaaguccaccggcauuuucgccgaguuccucaagcucaucguggggaaccaggcggacuucaaaaagcacuucaaccuggaggacaagaccccgcuccaguucgccaaggacagcuacgacgaggaccuggaaaaccugcucggccagaucggggacgaguucgccgaccuguucagcgccgccaagaagcuguacgacuccguccuccugucuggcauauuaacggucaccgaccucuccaccaaggcgccccugagcgccuccaugauccagcgcuacgacgagcaccgggaggaccugaagcagcucaaacaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcgcaagcagcgcaccuucgacaacggcuccaucccccaccaggugcacuugaccgagcuccgugccaucauccgccggcaguccgaguacuacccguuccugaaggaaaaccuggaccgcaucgagaagauccucaccuuccggauccccuacuacgucggcccccuggcccgcgagaaguccgacuucgccuggaugacgcggaagaccgacgacagcauccgccccuggaacuucgaggaccugguggacaaggagaaauccgccgaggcguucauccaccggaugaccaacaacgaccuguaccucccggaggagaaggugcugcccaagcacagccugauauacgagaaguucaccgucuacaacgagcucacgaaggugcgauuccuggccgagggguucaaggacuuucaguuccugaaccggaagcagaaggagaccaucuucaacagccucuucaaggagaagcgcaaggugaccgagaaggacauuaucuccuucuugaauaaggucgacggcuacgaggggaucgccaucaagggcauagagaagcaguucaacgccagcuuguccacguaucacgaccucaagaagauccuggggaaggacuuccuggacaacacggacaacgagcucauccuggaggacaucgugcagacccugacccucuucgaggaccgggagaugauccgcaagcggcuggacaucuacaaggacuucuucaccgagagccagcugaagaagcucuaccgccggcacuacacgggcuggggccgccuguccgcgaaacugauaaacgggauccggaacaaggagaaccagaagaccauccucgacuaccugaucgacgacggcagcgccaaccgcaacuucaugcagcugaucaaggacgccgggcucuccuucaagcccaucaucgacaaggcccgcaccggcagccaccuggacaaccugaaggagguggucggggagcucgcaggcucccccgcgaucaagaagggcauccugcagagccugaagaucguggacgagcucgugaaggucaugggguacgagccggagcagaucguggucgagauggcccgggagaaccagaccacggccaaaggccugucccgcucccggcagcgccugaccacccuccgggagagccuggccaacuugaaguccaacauccucgaggagaagaagcccaaguacgugaaggaccagguggagaaccaccaccugagcgacgaccgccuguuccucuacuaccugcagaacgggaaggacauguacaccgacgacgagcuugacaucgacaaccucucccaguacgacaucgaccacaucaucccccaggccuucaucaaggacgacagcaucgacaaccggguucugguguccagcgcgaagaaccgcggcaaguccgacgacgugcccagccuggagaucgucaaggacugcaagguguucuggaagaaguuacuggacgccaagcugaugucccagcggaaguacgacaaccucaccaaggccgagcgcgggggccugacgagcgacgacaaggcccgguucauccagcgccagcugguggagacccggcagaucaccaagcacgucgcccgcauccucgacgagcgguucaacaacgagcuggauucgaagggccgcagaauccgcaaggugaagaucgugacccucaagagcaaccucgucuccaacuuccggaaggaguucggguucuacaagauacgcgaggugaacaacuaccaccacgcgcacgacgccuaccugaacgccguggucgccaaggcgauccugacgaaguacccgcagcucgagcccgaguucguguacggcgacuaccccaaguacaacagcuacaagacccgcaaguccgccaccgagaagcuguucuucuacagcaacaucaugaacuucuucaagaccaaggugacgcuggccgacgggaccgucguggugaaggacgacaucgagguaaacaacgacaccggcgagauagugugggacaaaaagaagcacuucgccaccgugcgcaagguccucuccuacccccaggugaacaucgugaagaagacggagguccagaccggcggguucaguaaggagagcauccuggcccacggcaacuccgacaagcucaucccgcgcaagaccaaggacaucuaccucgaccccaagaaguacgggggcuucgacagccccaucguggcguacuccgugcuggugguggccgacaucaagaaggggaaggcccagaaacugaagaccgugacggagcuccugggcaucaccaucauggagcggagccgguucgagaagaaccccuccgccuuccuggagagcaagggcuaccuaaacauccggaccgacaagcugaucauccugccgaaguauucccucuuugagcuggagaacgggcgacgacgccugcucgccagcgcgggcgagcuccagaaggggaacgagcuggcccuuccaacccaguacaugaaguuccuguaccuggccucccgguacaaugagcucaagggaaagcccgaggagaucgagcagaagcaggaguucgucgugcagcacgugagcuacuucgacgacauccugcagaucaucaacgacuucuccaaccgcgucauccuagccgacgccaaccucgagaagaucaacaagcuguaucaggacaacaaggagaacaucccgguggacgagcuggcgaacaacaucaucaaccucuucacguucaccagccugggggcccccgccgccuucaaguucuucgacaagaucguggaccggaagcgcuacaccucgaccaaggagguucugaacagcacgcucauccaccaguccaucacuggccuguacgagacacggaucgacuugggcaagcucggggagggcuga

SEQ ID NO: 7779 - RNA, 4113 nt, Artificial Sequence
  Cas9 variant
augaacaagcccuacagcaucggccuggacaucgggaccaacuccgugggcuggagcaucaucaccgacgacuacaagguaccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuuugccgaggagauguccaagguggacgacagcuucuuccaccggcuggaggacuccuuccuggucgaggaggacaagcgcggcagcaaguaccccaucuucgccacgcuccaggaggagaaggacuaccacgagaaguucuccaccaucuaccaccuccggaaggagcuggcggacaagaaggagaaggccgaccuccgccugaucuacaucgcccuggcccacaucaucaaguuccgggggcacuuccucaucgaggacgacagcuuugacguacgcaacaccgacaucuccaagcaguaccaagacuuccuugagaucuucaauaccacguucgagaacaacgaucugcucucgcagaacgucgacguagaggcgauccugaccgacaagaucuccaagagcgccaagaaggaccggauccuggcccaguaccccaaccagaaguccaccggcaucuucgccgaguuccucaagcugauaguggggaaccaggccgacuucaagaaguacuucaaccuggaggacaagacgccccuacaguucgccaaggauagcuacgacgaggaccuggagaaccugcucggccagaucggggacgaguucgccgaccuguucuccgccgccaagaagcuguacgacagcgugcuccuuuccggcauccugacggucaucgaccucagcaccaaggccccgcucuccgcgagcaugauccagcguuacgacgagcaccgggaggaccugaagcagcucaagcaguucgugaaggccagccugcccgagaaguaccaggagaucuucgccgacuccagcaaggacggcuacgccggguacaucgagggcaagacaaaccaggaggccuucuacaaguaccuguccaagcuccugaccaagcaggaggacagcgagaacuuccuggagaagaucaagaaugaggacuuccuccgcaagcagcggacuuucgacaacggguccaucccccaccaggugcaccugaccgaauugaaggcgaucauccgccgccagagcgaguacuaccccuuucucaaggagaaccaggaccggaucgagaagauccugaccuuccgcaucccguacuacaucggcccccuggcucgggagaaguccgacuucgccuggaugacccgcaagacugacgacagcauacggcccuggaacuucgaggaccucgucgacaaggaaaaguccgccgaggccuucauccaccgcaugacgaacaacgauuuuuaucugcccgaggagaaagugcugccgaaacacagccugaucuacgagaaguucaccguguacaacgagcuuaccaagguccgguauaagaacgagcagggcgaaacguacuucuucgacuccaauaucaagcaggagaucuucgacgggguguucaaggagcaccgcaaggugagcaagaagaagcugcuggacuuccucgcgaaggaguacgaggaguuccggaucgucgacgugaucggccuggacaaagagaacaaggccuucaacgcaucccuggggaccuaccacgaccucgagaagauccuggacaaggacuuccuggacaaccccgacaacgaaagcauacucgaggacaucgugcagacccugacccuguucgaggaccgcgagaugaucaagaagcggcucgagaacuacaaggaccuauucacggagucccagcugaagaagcucuaccgccggcacuacaccggcugggggcgccugagcgccaagcugaucaacggaauccgggacaaggagucccagaagaccauacucgacuaccugaucgacgacggccgcagcaaccggaacuuuaugcagcugaucaacgacgacggucucuccuucaagagcaucaucagcaaggcgcaagccggcucccacagcgacaaccugaaggaggucgugggggagcuggccggcucccccgccaucaagaaggggauucuccaaagccugaagaucguggacgagcugguuaaagugaugggcuacgagcccgagcagaucgucguggagauggcccgcgagaaucagaccacgaaucagggccggcgcaacagucgccagcgguacaagcuccuggacgacggggugaagaaccuggcgagcgaccucaacggcaacauccugaaggaauacccgaccgacaaccaggcccuccagaacgagcgccucuuucuguacuaccugcagaacgggcgggacauguacaccggcgaggcccucgacaucgacgaccugucccaguacgacaucgaccacaucaucccccaggccuucaucaaggacgacagcaucgacaaccgcguccugguguccagcgccaagaacagaggcaaauccgacgacgugcccucccucgagaucgucaaggacugcaagguguucuggaagaagcugcuggacgcgaagcucaugucccagcgcaaauacgacaaccugaccaaggccgagcggggcggccugacgagcgacgacaaggcccgcuucauccagcggcagcucguggagacccgccagaucaccaagcacgucgcccggauccuggacgagcgcuucaacaacgagcuggacuccaaggggcggcgcauucggaaggugaagaucgugacccucaagaguaaucuggucuccaacuuccgcaaggaguucggcuucuacaagaucagggaggugaacaacuaccaccacgcccacgacgcguaccugaacgccguggucgccaaggccauccucaccaaguacccccagcuggagccggaguucguguacggagacuaccccaaguacaacagcuacaagacgcgcaagagcgcaaccgagaagcuguucuucuacuccaacaucaugaacuucuucaagacuaaggugacccucgccgacggcacggucguggucaaggacgacaucgaggucaauaacgacacgggcgagaucgugugggacaagaagaagcacuucgccaccguccggaagguccuguccuacccccagaacaacaucgugaagaagaccgagauccagaccgggggcuucagcaaggagagcauccuggcccacgggaacuccgacaagcucaucccccggaagaccaaagacaucuaccuggacccgaagaaguacggcggguucgacagccccaucguggccuacuccgucuuagugguggcggacaucaagaaaggcaaggcccagaagcucaagaccgucaccgagcuacugggcaucacgaucauggagcggagccgcuucgagaagaaccccuccgccuuccucgagagcaagggguaccugaacauccgcgccgauaagcugaucauccuccccaaguacucccuguucgagcuggagaacggccgacgccggcuucuggccucggcgggggaacuucagaagggcaacgagcucgcccugccgacccaguucaugaaguuccuguaccuagccucccgcuauaacgagagcaaggggaagcccgaggagaucgagaagaagcaggaguucgugaaccagcacguguccuacuucgacgacauccugcagcugaucaacgacuucagcaagagggucauccucgccgacgccaaccuggagaagaucaacaagcuguaccaggacaacaaggagaacaucuccguggacgagcucgcgaacaacaucaucaaccuguucaccuucaccagucugggcgcccccgccgccuucaaguucuucgacaagaucguggaccgcaagcgguacacguccaccaaggagguccucaacagcacccugauccaccagagcaucaccggccuguacgagacgcgcaucgaucucgggaagcugggcgaggacuga

SEQ ID NO: 7780 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaauacaucaagaagaaccugaucggggcgcugcuguucgaugggggcaacacggcugccgaccggcgccugaagcggaccgcccgccggcgcuacacccggcgccggaaccgcauccuguaccuccaggagaucuucgccgaagagauguccaagguggacgacagcuucuuccaccggcuggaagacaguuuccuggucgaggaggacaagcgcggcagcaaauaccccaucuucgccacgcuccaggaggagaaggacuaccacgagaaguucuccaccaucuaccaccuccggaaagagcuggcggacaagaaggagagggccgaccuccggcugaucuacaucgcccuggcccauaucaucaaguuccgcgggcacuuccucaucgaagacgacagcuucgaugugcggaacaccgacaucaguaagcaguaccaggacuuccuggagaucuucaauaccacguucgagaacaaugaccugcuuucucagaauguggaugucgaagcgaucuugaccgacaagaucuccaaaagcgccaagaaagaccgcauccuggcccaguaucccaaccagaaguccaccggcauuuucgccgaguuccucaagcugaucgugggcaaccaggccgacuucaagaaauacuucaaccuggaggacaagacgccccuccaauucgcuaaggauagcuacgacgaggaccuggagaaccugcucggccagaucggggacgaguucgccgaccuguucagugccgccaagaagcuguacgacagcguacuccuguccggcauccugacggucaucgaccucagcaccaaggcaccccuauccgccagcaugauccagcgguacgacgagcaccgcgaggaccugaagcagcuuaagcaguucgugaaggccagcuugccggaaaaguaccaggagaucuucgccgacucaagcaaggacggcuacgccggguacaucgagggcaagaccaaccaggaagccuucuacaaguaccuguccaaguuacuaaccaagcaggaggacagcgagaacuuccuggagaagaucaagaacgaggacuuccuccguaagcaacgcacguucgacaacgguuccaucccgcaccaggugcaucugaccgagcugaaggcgaucauccgccggcagagcgaguacuaccccuuccugaaggagaaccaggaccgcaucgagaagauccugaccuuccggaucccguacuacaucggcccccuggcccgcgagaaguccgacuucgccuggaugacccggaagacggacgacagcauccgccccuggaacuuugaggaccucgucgacaaggagaaguccgccgaagccuucauccaccggaugaccaacaacgacuucuaccugcccgaggagaaggugcugccgaagcacagccugaucuacgagaaguucaccguguacaacgaacucaccaagguccgcuacaagaacgagcagggcgagacguacuucuucgacuccaacaucaagcaggagaucuucgacgggguguucaaagagcaccggaaggugagcaagaagaagcugcuggacuuccucgcgaaggaguacgaggaguuccgcaucguugacgugaucggccuggacaaggaaaacaaggccuucaacgccucccuggggaccuaccacgaccucgagaagauacuggacaaggacuuccuggacaaccccgacaacgaaucuauccucgaggacauugugcagacccugacccuguucgaggaccgggagaugaucaagaagcgccucgagaacuacaaggaccuguucacggagucccagcuuaagaagcucuaccgucgccacuacacgggcugggggcggcugucugccaaguugaucaauggcauccgcgacaaggagucccagaagaccauccucgauuaccugauagaugacggcaggucaaaccgcaacuucaugcagcugaucaacgacgacgggcugaguuucaagagcaucaucagcaaggcgcaggcgggcucccacagcgacaaccugaaggagguagugggggagcuggccggcucucccgccaucaagaaggggauccuccagucccugaagaucguggacgagcuggucaaggugaugggcuacgagcccgagcagaucgucguggagauggccagggagaaccagaccacgaaccagggccgccgcaacucccggcagcgcuacaaacuucuggacgacgggguuaaaaaccuagcgagcgaccucaacggcaacauccugaaggaauacccgaccgacaaucaggcccugcagaacgagcgccucuuccuguacuaccugcagaacgggcgggauauguacaccggcgaggcccucgacaucgacgaccugucccaguacgacaucgaccacaucaucccccaggcauucaucaaggacgacagcaucgacaaccggguccugguguccagcgccaagaaccgcgggaaguccgacgacgugcccagccucgagauagucaaggacugcaagguguucuggaagaagcuguuggaugcgaagcucaugucucaaagaaaguacgacaaccugaccaaggccgagcgcgggggacugacgagcgacgacaaggcccgguucauccagcgccaacucguggagacccggcagaucaccaagcacgucgcccgaaucuuagacgagcgguucaacaacgagcuggacuccaaggggcgccggauccgcaaggugaagaucgugacucucaagucaaaccuggucuccaauuuccggaaggaguucggcuucuacaagauccgcgaaguaaacaacuaccaccaugcacacgacgcguaccugaacgccguggucgccaaggcgaucuuaaccaaguacccccagcuggagccugaguucguguacggggacuaccccaaguacaacagcuacaagacgagaaagagcgcgacugagaaguuguucuucuauuccaauaucaugaacuucuuuaagaccaaggugacccucgcagacgguacggucguggugaaggacgacaucgaggucaacaacgacaccggcgagaucgugugggacaagaagaagcacuucgccacaguccggaagguccugagcuacccccagaauaacaucgugaagaagaccgagauccagaccgggggcuucuccaaggagagcauccuggcccacgggaacuccgacaagcucaucccccggaagaccaaggacaucuaccuggacccgaagaaguacggcggguuugacagccccaucguggccuacuccguccuggugguggcggacaucaagaagggcaaggcacagaaacucaagaccgucacugaacugcugggcaucacgaucauggagcgcagccgcuucgagaagaaccccuccgccuuccucgagagcaagggguaccugaacauccgggccgacaagcugaucauccucccaaaguacucccuguucgagcuggagaacggccgccggcgccucuuggccagcgccggggagcugcagaagggcaacgagcucgcacuuccgacccaguucaugaaguuccuguaccucgccucccgguacaacgagagcaaggggaagcccgaggagaucgagaagaagcaggaguucgugaaccagcacguauccuacuucgacgacauccugcagcuaaucaacgacuucagcaagcgcgucauacucgcugacgccaaccuggagaagaucaacaagcuguaccaggacaacaaggagaacaucuccguggacgagcucgcgaacaacaucaucaaccuguucaccuucaccagcuuaggcgcccccgccgccuucaaguucuucgacaaaaucguggaccggaagcgguacacauccaccaaggagguccucaacucuacccugauccaccagagcaucaccgggcuguacgaaacgcggaucgaccucgggaaacugggggaggacuga

SEQ ID NO: 7781 - RNA, 4113 nt, Artificial Sequence; identical to SEQ ID NO: 1981
  Cas9 variant

SEQ ID NO: 7782 - RNA, 4113 nt, Artificial Sequence; identical to SEQ ID NO: 1982
  Cas9 variant

SEQ ID NO: 7783 - RNA, 4116 nt, Artificial Sequence; identical to SEQ ID NO: 1983
  Cas9 variant

SEQ ID NO: 7784 - RNA, 4116 nt, Artificial Sequence; identical to SEQ ID NO: 1984
  Cas9 variant

SEQ ID NO: 7785 - RNA, 4116 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaauacugaccgccacuccaucaaaaagaaccugaucggagcccugcuguucgacucaggggagaccgcggaggccacccggcugaagcgcaccgcccggcgccgguacacgcgccggaagaaccgcauccgguaccugcaggagaucuucuccagugagauguccaaggucgacgacagcuucuuccaccgccucgaggaguccuuccuaguggaggaggacaagaagcacgagcggcacccgaucuucggcaacaucguggacgaggucgccuaccacgagaaguacccgaccaucuaccaccuccgcaagaagcucgccgacagcacggacaaggcggaccugcggcugaucuaccucgcccuggcccacaugaucaaguucaggggccacuuccugaucgagggggaccucaaccccgacaacuccgacauggacaaacuuuucauucagcuggugcagaccuacaaccagcuguucgaggagaaccccauaaacgccagccggguggacgcgaaggccauccuguccgcccgccugagcaagucccggcgccucgagaaccugaucgcucagcugccgggcgagaagcggaacggccucuucgggaaccugaucgcccugagccucgggcugacgcccaacuucaaguccaacuucgaccuggcggaggacgccaagcuccagcugagcaaggacacuuacgacgacgaccuugacaaccuccuggcccagaucggcgaccaguacgccgaccuguuccucgccgcaaagaaccuguccgaugcaauccugcucagcgacauccugcgcgucaacagcgagaucaccaaggcgccccuguccgccagcaugaucaaacgguacgacgagcaccaucaggaccucacccugcugaaagcccucguccgacagcagcugcccgagaaguacaaggagaucuucuucgaccaauccaagaacggguacgcgggguacaucgacggcggggccagccaggaggaguucuacaaguucaucaagccgauucuggagaagauggacgggacggaggagcuccuggccaagcugaaccgcgaggaccugcuccggaagcagcgcacguucgacaacggcuccaucccccaucagauccaccugggggagcugcaugccauccucagacgccaggaggacuucuaccccuuccugaaggacaaccgggagaagaucgagaagauccugaccuuccgcauccccuacuacgugggcccgcucgcccgggggaacagccgcuucgcguggaugacccggaaguccgaggagacgauaacccccuggaacuucgaggaggucguggacaagggcgccagcgcccaauccuucaucgagcgcaugaccaacuucgacaagaaccuacccaacgagaaggugcugcccaagcacagccuacuguacgaguacuucaccgucuacaacgaacugacgaaggugaaguaugugaccgaggguaugaggaagccggaguuccucuccggcaagcagaaggaggccaucgucgaccuucuguucaaaaccaaccgcaaggugaccgugaagcagcucaaagaggacuacuuuaagaagaucgagugcuucgacagcgucgaaaucuccggcguggaggaccgguucaacgcgagccuggggacguaccacgaccugcucaagaucaucaaggacaaggacuuccuggacaaugaagagaacgaggacauccuggaggacaucgugcucacccugacccuguucgaggacaaggagaugaucgaggagcgccucaagaccuacgcccaccuguucgacgacaaggucaugaagcagcugaagcggcgccacuacacuggcugggggcggcucucccgcaaguugaucaacggcauccgggacaagcagagcgggaagaccauccuggacuuccucaaguccgacggcuucgccaaccgcaacuucauccagcugauccacgacgacagccugaccuucaaggaggccauccagaaggcccagguguccggccaggggcacagccuccacgagcagaucgcgaaucuggccggcagccccgccaucaagaaggggauccugcagaguguuaaggugguggacgagcucgucaaggugaugggccacaagcccgagaacaucgugaucgagauggcccgcgagaaccagaccacgcagaaggggcagaagaacagccgggagcgcaugaagcggauugaggagggcaucaaggaguugggaucccagauccuaaaggagcaccccgucgagaacacccagcuccagaacgagaagcuguaccuguauuaccuccagaacgggcgcgacauguacgucgaccaggagcuggacaucaaccggcugagcgacuacgacguggaccacaucgucccgcaguccuucaucaaggacgacagcaucgacaacaaggugcucacccgcuccgacaagaaccggggcaagagcgacgacgugcccuccgaggaggucgugaagaagaugaagaacuacuggcgccagcugcugaacgccaaguugaucacccagcggaaguucgacaaccugacgaaggcggagcgcgggggccugagcgagcucgacaaggccggcuucaucaagcggcagcugguggagacccgccagaucaccaagcacgucgcccagauccuggacucccggaugaacaccaaguacgacgaaaacgacaagcucauacgcgaggugaaggugaucacccucaagagcaagcuggucuccgacuuccggaaggauuuccaguucuacaaggugcgcgagaucaacaauuaccaccaugcccacgacgccuaccucaacgcggugguggggacggcccugaucaagaaguaccccaagcuggagagcgaguucguauacggcgacuacaagguguacgacguccggaagaugaucgccaaguccgagcaggagaucgggaaggccaccgcgaagcgcuucuucuauagcaacaucaugaacuucuucaagacggagaucacccucgccaacggcgagauccggaagcgcccccugaucgagacgaacgaggagaccggggagaucguguggaacaagggccgggacuucgccaccgugcgcaagguccuguccaugccccaagugaacaucgugaagaagaccgagguccagacgggcgcccucacgaacgagagcaucuacgcccgcgggagcuucgacaagcugaucucccggaagcaccgcuucgagagcuccaaguacggcggguucggcagcccgaccgugaccuacuccgugcucgucguggccaagagcaaggugcaggacgggaaggucaaaaagaucaagacgggcaaggagcucaucggcaucacccugcuggacaagcucguguucgagaagaacccccugaaguuuaucgaggacaagggguacggcaacgugcagaucgacaagugcaucaagcugcccaaguacucccucuucgaguucgagaacgggacccggcguaugcuggccagcgucauggccaacaacaacucccggggcgaccugcagaaggccaacgagauguuccucccggccaagcuggugacccugcucuaccacgcgcacaagaucgagagcuccaaggagcuggagcacgaggccuacauccuggaccacuacaacgaccucuaccagcugcugagcuauaucgagcgcuucgccucccucuacguggacgucgagaagaacaucagcaaggugaaggagcuguucuccaacaucgagagcuacuccaucucggagaucugcuccagcgugaucaaccugcucacgcugaccgccagcggggcccccgcggacuucaaguuccugggcaccacaaucccccggaaacguuacggcuccccgcagagcauccucuccucaacgcugauccaccaguccaucaccggacuguacgagacccggaucgaucucagccagcugggcggggacuga

SEQ ID NO: 7786 - RNA, 4116 nt, Artificial Sequence
  Cas9 variant
augaacaacaacaauuacagcaucggccuggacaucgggaccaauuccgugggcugggccgucaucaccgacgacuacaaggugcccagcaagaagaugcgcgugcucgggaacacggacaagcgguucaucaagaagaaccuaauuggagcccugcuguucgacgaggguaccaccgcggaggaccgccggcugaagcgcaccgcccgacgccgguacacgcgccggaagaaccgccugcgguaccuccaggagaucuucgccgaggagauguccaagguagacagcuccuucuuccaccgccuggacgacagcuuccuggugccggaggacaaguccggcagcaaguaucccauauucgccacccucgccgaggagaaggaguaucacaaaaaguuccccaccaucuaccaucuucggaagcaccuggcagacucaaaggagaaggccgaccuccgccugauuuaccuggcccucgcccacaucacuaaguaccggggccacuuccuguaugaggaggcguucgacaucaaaaacaaugacauccagaaaaucuucaacgaguucaucaauauuuacgacaacacuuucgaggggagcucccugagcggccagaacgcccaggucgaggccaucuucaccgggaagaucuccaagagcgucaagcgcgagcacgugcugaagcuguuccccgacgagaaguccaccggccuguuuagcgaguuccucaagcugaucguggggaaccaggccgacuucaagaagcacuucgaccuugaagagaaggcuucccuccaguucagcaaggauaccuacgacgaggaccuggagaaccugcucggccagaucggcgacgacuucgcugaucuguuccuggucgccaagaagcucuaugacgccauccugcuguccgguauccucacggugaccgacccgagcaccaaggcgccccugagcgccuccaugaucgagcgguacgagaaccaccaggaagaucuggccgcccucaagcaguuuaucaagaauaaucugcccgagaaguacgccgagguguucagcgaucaguccaaggauggcuacgccggguacaucgacggaaagaccacgcaggaggccuucuacaaguacaucaagaaucugcucagcaaguuugagggcgcggacuacuuccuugacaaaaucgagcgcgaggacuuccugcggaagcagcgcaccuucgacaacggguccaucccccaccagauacaccuccaggagaugaacgccauccugcggcgccagggugagcacuacccgcugcucaaggagaacaaggagaagaucgagaagauccugaccuuccgcauccccuacuacgucgggccucuggcccggggcaaccgagacuucgccuggcucacccggaacagcgaccaggccauucgccccuggaacuucgaggagaucguugacaaggcgucgagcgccgaguccuucaucaacaagaugacgaacuaugaccuguaucugccggaggagaaggugcugcccaaacacagccuccucuacgaaaccuucgcagucuacaacgagcugaccaaggugaaguucaucgccgaggggcuccgggauuaccaguucuucgacuccggccagaagaagcagaucgucaaucagcuguucaaagagaagcgcaaggucaccgaaaaggauaucauccacuaccugcacaacguggacggauacgacgggaucgagcucaagggcaucgagaagcaguucaacgcgagccugagcacguaccacgaucugcucaagaucaucaaggacaaggaguucauggacaaccacaagaaucaggagauccuggagaacaucgugcacacccugaccaucuucgaggaccgggaaaugauuaagcagcgccucgcccaguacgacagcaucuucgacgagaaggucaucaaggcccugacccggcgccacuacacggggugggguaagcucuccgccaagcucaucaacgggaucugcgacaagaagaccggcaagacaauccuggacuaccugaucgacgacggcuacaacaaccggaacuucaugcagcucaucaacgacgacggccugagcuucaaggagauuauccagaaggcccagguggugggcaagaccgacgaccuaacgcaggucgugcgcgagcucuccgggagccccgcgaucaagaaggggauacugcaguccaucaaaaucguggacgagcugguuaagaucaugggguacgcccccgaaagcaucguaaucgaaauggcccgggaaaaccagaccaccgccaagggcaagaagaauagccagcagcgcuacaagcggaucgaggacgcacucaagaaccuggcgccgggccuggacuccaccaucagcaaggagaaccccacggacaacauccagcuccagaacgaccgccuguuccuguacuaccuccagaacgggaaggacauguauaccggcgaggcccuggacaucaaccagcuguccagcuacgauaucgaccacaucaucccacaggcguucaucaaggacgacucccucgacaaccggguccugaccucauccaaggacaaccgcggcaagucagacaacguacccagucuggaggugguaaagaagcggaaggccuucuggcagcagcuccuggacuccaagcugaucuccgagcgcaaguucaacaaccucaccaaggccgaacgcgggggccuggacgaacgggacaagguuggguucaucaagcgccaacucguggagacccgccagaucacgaagcacgucgcgcgcauccucgacgcccgguucaacaccgaggugagcgagaaaaaccagaaaauccgcuccgugaagaucaucacccucaagagcaaccuggucuccaauuuccggaaagaguucaagcuguauaaggugagagagaucaacgauuaccaccacgcccaugacgcguaccugaacgcggugguagccaaggccauccugaagaaguacccgaaguuagagcccgaguucguauacggggacuaccagaaguacgaccugaagcgguacaucuccaaguccaaggacccuaaggaaguggagaaggccaccgagaaguauuucuuuuacagcaaccugcucaacuucuucaaggaggagguccacuacgccgacgggacgaucgucaagcgcgagaacaucgaguacagcaaggacaccggcgaaaucgcguggaacaaggagaaggacuucgugaccauuaaaaagguccuguccuacccacaggugaacaucgugaagaagcgugagguacagaccggggguuucagcaaggaguccauccugccgaagggcaacagcgacaagcucauaccccgcaagacgaaggacauccugugggacaccaccaaguacgggggcuucgacucccccgugaucgccuacagcauccuguugaucgcugacaucgagaaggggaaagccaagaagcugaagaccgugaagacgcuggugggcaucaccaucauggagaaggccgcguucgagaaaaaccccaucaccuuccucgagaacaagggguaccacaacgugcggaaggagaacauccugugccugccgaaguacucccucuucgagcuggagaacggccgacggcgccugcucgccuccgccaaggagcugcagaagggaaacgagaucguacugcccgucuaccucaccacgcuguuauaccacuccaagaacgugcacaaguuagaugagccggagcaccuggaguacauccagaagcaccgguacgaguucaaggaccugcucaaucugguguccgaguucucccaaaaguacguccuggccgaggccaaccucgagaagaucaagagccuguacgucgacaacgagcaggcggacaucgagauucuggccaacuccuuuaucaaccuccugaccuucaccgccuugggggccccagccgccuucaaguucuucggcaaggacgucgaccgcaagcgcuacaccacggucagcgagauccucaacgccacccugauccaccaguccaucaccgggcuguacgagacacgcauagaccucagcaagcugggcgaggacuga

SEQ ID NO: 7787 - RNA, 4116 nt, Artificial Sequence
  Cas9 variant
augaccgagaagaacuacagcaucggccuggacaucgggaccaacuccgugggcugggccgugaucacggacgacuacaaggugcccgccaagaagaugaaggugcucgggaacaccgacaagaaguacaucaagaagaaccugcugggcgcgcuccuguucgacaacggggagaccgccgaggccacccgccugaagcggacggcccgccggcgcuacacccggcguaagaaccggcuccgcuaccugcaggagaucuucgccgaggagauggcgaaggucgacgagagcuucuucuaccggcuggacgaguccuuccucaccacagacgacaaggauuucgagcgccacccgauauucggcaacaaggccgacgagaucaaguaccaccaggaguuccccacgaucuaccaccuccggaagcaccuggccgacagccacgagaaggccgaccuccgccugaucuaccuggcgcucgcccacaugaucaaguuccggggccacuuccugaucgagggggagcugaacgcagagaacaccgacgugcagaagcuguucgaggccuucguggaggucuacgaccgcacuuucgacgacuccaaccugagcgagaucaccguggacgccuccagcauacugacggagaaguucuccaagagccggcgccucgagaaccugaucaagcacuaccccaccgagaagaagaacacccuguucggcaaccucguggcgcuggcccuggggcuccagcccaacuucaagaccuccuucaagcugagcgaggacgccaagcugcaguucuccaaggacacguacgaggaagaccucgaggagcugauaggcaagaucggggacgaguacgccgaccuguucaccagcgccaagaaccucuacgacgcgauccugcuguccggcauccucaccgucgccgacaacacaacgaaggccccacugucugccuccaugaucaagcgguacaacgaacaccagguggaccugaagaagcucaaggaguucaucaagaacaacgccucugacaaguacgacgagaucuucaacgacaaggacaagaacggcuacgcgggguauaucgagaacggcguaaagcaggacgaguuuuacaaauaccugaagaccacccuguccaagauagacgggagcgacuacuuccucgacaagaucgagcgcgaggacuuccugcggaagcagcgcaccuucgacaacggcagcaucccccaccagauccaccuccaagagaugcacgccauccuccggcgccagggcgagcacuacgccuuccugaaggagaaccaagccaagaucgagaagaucuuaacguuccgcauucccuacuacgucgggccccucgcccggaaaaauucccgcuucgcuugggccgaguaccacagcgacgagaagaucacccccuggaacuucgacgagaucaucgacaaggagaaguccgccgaaaaguucaucacccggaugacccugaacgaccuguaccugcccgaggagaagguucuccccaagcacagccugguguacgagacguacaccgucuacaacgagcugaccaaggugaaguacgugaacgagcaggggaaguccaacuucuucgacgccaacaugaagcaggagaucuucgagcacgucuucaaggagaaucgcaaggugaccaaggacaaguuccucaacuaccugaacaaagaguuccccgaguaccggauccaggaccugaucgggcucgacaaggagaacaagagcuucaacgcgucacugggcacguaccacgaccugaagaagauccucgacaagagcuuccuggacgacaagaccaacgagaccaucaucgaggacaucauccagacccugacgcuguucgaggaccgcgacaugauucggcagcgccugcagaaguacuccgacaucuucaccccgcaacagcugaagaagcucgagagacgccacuacaccggguggggccggcugagcuacaagcugauaaacggcaucagaaacaaggagaacgggaaguccauccucgacuaccugaucgacgacggcuacgccaaccggaacuucaugcagcugaucagcgacgacacccuccccuucaagcagaucaucaaggacgcccagaucaucggggacauagacgacgugaccuccgucgugcgcgagcugcccggcagccccgccaucaagaaggggauccugcaguccgugaagaucgucgacgagcucgugaaagucaugggccacaacccggacaacaucgugaucgagauggcccgggagaaccagacgaccaaccguggucggaaccaaagccagcagcgccugaagaagcugcaggacucccucaaggagcuggggagcaacauucugaacgaggagaagcccuccuacaucgagggcaagguggagaacaaccaccuccaggacgaccggcuguuccuguacuacauccagaacgggaaagacauguacaccggcgacgagcucgacaucgaccaucugagcgacuacgacaucgaccacaucaucccccaggcguuuaucaaggacgacagcaucgacaaccgcguccugaccuccagcgccaagaaccgcgggaagucugacgacgugcccagccucgauaucgugcacgaccggaaggccgacuggauccgccuguacaaguccggccugaucagcaagcggaaguucgauaaccucacgaaggccgagcgcggcggguugaccgaaaacgacaaggccggcuucaucaagcggcagcuggucgagacucgccagaucaccaagcauguggcgcagauccucgauucccgguucaacacggagcgugacgagaacgacaaggugauucggaacgucaaggugauaacccucaagagcaaccuggugucccaguuccgcaaggacuucaaguucuacaaggucagggagaucaacgacuaccaccacgcccacgacgcauaccugaaugccgugguggggaccgcccugcugaagaaguacccgaaguuagcgcccgaguucgucuacggcgaguacaagaaguaugacauccgcaaguucaucaccagcuccggcgacaaggccacggccaaguacuucuucuacagcaaccugaugaacuucuucaagcgggugauccgcuacuccaacggcaagguggucgugcggcccgugaucgagugcagcaaggacaccggcgagaucgccuggaacaagcagaccgacuucgagaagguccgccgggugcuguccuacccccaggugaacaucgucaagaagguggagacccagaccgggggcuucagcaaggagagcauccucccgaaggggaacagcgacaagcugaucccccgcaagacaaagaaguuccggugggacacccccaaguacggcggcuucgauagccccaacaucgcguacuccguguucgucaucgccgacguggaaaaggggaaggccaagaagcugaagaccgugaaggagcuugucggcaucagcaucauggagcgcuccagcuucgaggagaacccggugguguuccuggagaagaagggcuaccaaaauguccaggaggauaaccugaucaagcuccccaaguacucccuguucgaguuugagggcgggaggcgccgccuacucgccagcgccuccgagcugcagaagggcaacgagguggugcugagccggcaccucgucgagcugcuguaccaugcgcaccgcgugaacuccuucaacaacagcgagcaccucaaguacguguccgaacacaagaaggaguucggcgagguccugagcugcguugaaaacuucgccaaguccuacguggacgucgagaagaaccuggggaagauccgggccguggccgacaagaucgacacguucagcaucgaggacaucuccaucagcuucgugaaccuccugacccugaccgcccucggcgcgcccgccgacuucaacuuccugggggagaagaucccgcgcaagcgguacaccuccacgaaggagugccugaacgccacccucauccaccagagcaucaccggccuguacgagacccgcaucgaccuguccaagcucggggaggaguga

SEQ ID NO: 7788 - RNA, 4116 nt, Artificial Sequence
  Cas9 variant
augaaccucagaaacguggagucauaccaagugggacuagacaucggcaccgggagcgucgggugggcaguccucgacgacaacggagauuuaugcagauucaagggaaaaccgaccuggggcuccagagucuucccgacggcagaaacagcggcagaggcacgcguccaccgcggacagagacgaagguacgaccgacgccgacaaaggaucgaucucuuacaacgcuucuucgccgacgagguagcaaaaguagacccagaguucuucaucagauuaaaccaggcucgccugcacccagaaaaccgcgaccccgcccacgccgacuaccgauggccguuguucaacgguucgaacuucaccgagaaggauuacuaccgacaguucccaacaauauaccaccuacgagcacaccuguugaagucggacgaacccgcggacauacggcuaguguaccuagcacuacauaacaucguuaagcaucgaggaaacuuccuacaccaagacaauccaucgcucucggcccggaacgcaaacguaggugacgccguugaagcacugugccucgccuuggacgaauggugcggggcucacgaugucgaaugcgccugugacgaggcggcucuugcagaagcgcuaggugaugcgagcuuacgaccgggcgagaaaagggaaagggcagaagccgcgcuaggcgucgaaaaggcccacaaaaaguuagcuaaagccgugaguucagcagugguaggguacgcagcggaauuuggacacguuuucuucgccgaauccgaaggguccaaauucgcacuaucaaacgacgaaaaaguagaggcuuauguaugccccgaugaaggaagagaccuauucgacgccaugcgagcgguacacagcuccuauguacuuaugggcauccuauccgaagcacaaggggagcuccucagcgucugcaaagugggcgaguaugaaagauacaagagagaccuggaaacacuaaaaagucugguuagagcguauggcccggaaagauacgacgaguucuucugugggccauucuacgaaggaacaagggauuaugacccgggaaaagcacagggauacaccaaauauaaccugggcgcauccaagcucagucaugaagacuuccuaaaagagguacagaaacuucugaaagauaucggggcacaggcggacgaacguuacgcagacaucgaacgagcaauagaagccggagcauuccucaggcgccugaaaacuagcgacaacggcaccauaccuuaccaacugcaccucgaagagauggacgccauaaucgagagacaagccgcauucuaccccuuccucgcgcaagaaaaggacaagcugaagucccuagucagcuuccgaaucccauauuacguaggcccgcuaacacagaaaaacgcagcaagggacggcaagggcgaggcacgauuugccuggagcucgcgaaagcccgguauggaggaugcgaggguauacccauggaacugggaggacgucauagauaaggaccaaucggccgaagacuucauacgacggaugacggggaccugcacuuaccucaaaggcgagccgguacuggcccgcugcucucucgacuacgagcuguucugcgucuugaacgaacucgccggagcucgauggacccaagacggcgacaaaagcuaccgauucgacgcagcagaccgacuuggcaucgucgaagaccuguucaagaaaagaaaacgagucacauacgaggccgcggagaaauggcuagcaagaacgcacggaccugaauccggaaagagcgcaggcggcgcauaccacguaucaggcggccaaggcgaagacgccuucgaaagccaacuaucaagccacuacgacuucugcaaaauacucggggucgacgaacuaagcgacgcggacgaagcaauggcggaagacauaauccucuggaacacagucuucgaagaccgcucuauacugaagcggaaaaucaaacuagcguacggagacaggcugggagacgcccaaguaagaaaacuaugucagaaacgguacacaggcuggggcagacuaucaggggagcuccuccgcggauuaagaucggcaacagacaauggaccaaaaacgauaauggacauacuccuagagggcgacccgaaucacgcgcgcagaaugggagccgcaaugaauuuaauggaaauucuccacgacgaccuacuggaguuccaagcuaaaaucgacgaacauaaccgagaacgcgcccuggcagucggaggcaugagcguagacgaagucacaggaucaccggcgcuaagacgaggaauaaaucaagcucuccggguagucgacgaaaucgccgggauagcggggaaaccaccagcgcacaucuacgucgaaguuacacgggaugaaggagcgcggaacaagggacggcgcacgacgagccgauaccgagcacuagaagccgcacucucaagcauaaaagcccagugcgccgacguauacgccgaacuaaaagaaagagaccccagggcauuggaugacgaaaggcugacgcucuauuucaugcaauguggcaaaugcauguacaguggagacgcacuggacaucaacaaacuacaaacauaucagguagaccauauacuaccgcaaucguauguaaaggacgacagcuuugaaaacaaagugcuagugagaccugacacaaaccagcgcaaaggagacacacugcugcuagacgaaagacuaaucgcccggaugagaggguucuggcgaacccuacgagacgcggagcucauaggagagaagaaauucaacaaccuaacacgcaccaguguauccgaugagcagaugaagaaauucgucucaagacagcuaguggaaacaggacagauggugaaacaaguccagcagcuucuacaagcccgcuaccccgagagcgagguccaaccagucaaagcgggggucucccaccaacucagaguuggaugcgcauuagcgaaaagccgagagauaaacgacuuccaccacgcgcacgacgcguaccuugcgugccaagugggacgguuugugcaauacagacacagugccgucuacuccgaaccaguaaaaauggcggcgguggucaaacaauucauaaagaaacaagccgaagauuacaggcgaacccgagaacuacccgggucugacggcuuuaucgucuccagcuucaugacgcccggcuucgacguaaaaacaggggaagucuucagagacgcaugggacgccggagcagagauagacagaauccggagaugcuuugacuauaaagacugcuucauaagcagaaugcccgaagaaacacauggcgcauucugggacgcaacgaucuacagcccaagagcagcaggaaaaacguugucccuaccgcuaaaacgcggauuagacccacgaaaauacggaucguacaguagggaacaauucgccuacuucuucgucuacgaagcggucaaaccuaaaaagaaacaaagaguccuugaguucgccccagugccaguccggguagcuagcgcacucgcuaaugacccggaugcguuggaagacuacgcccgcgaacucgcagaagcagaagggcuggucuucgaaagaauuagaaggcgcaaaguuuacaaguaccaacaaaucauagugggugacagcagacuguacguaacaggacgagaggaaguacguaaugcucggcagcucgcauucagccaggacgaaacuaaguuaauaugcagaaucgagcagggggaagagugcgaagaaggagaacuccuagaccucuucaggagcaugcagcggaaauaccuagccugugccccucgucucgcuagacuuaugaaaguagccgaaauggaggaaggauucauagccgcaacagcuaguggaaaaagggaaguccuucucucacugacuagcauagcagccgcacacagaaacagcaucgaccuaaaaccaaucggcaggaaaggcuccuccggccaaaugaaaauaacauucaguaaagaguugagcaccaacgggauacuauucgucgauuccucagucacaggcauguucgaacgccgcugcaggcuaggacucuga

SEQ ID NO: 7789 - RNA, 4116 nt, Artificial Sequence
  Cas9 variant
auggagaacaagaacuacagcaucggccuggacaucgggaccaacuccguuggcuggagcgucaucaccgacgacuacaaggugcccuccaagaagaugaaggugcucgggaacacggacaagcgcuucaucaagaagaaccugaucggcgcccugcuguucgacgagggcaccaccgccgaggcgcggcgccugaagcggaccgcccgccggcgcuacacgaggcgcaaaaaucggcugcgcuaccuccaggagaucuucgccgaggagaugagcaaggucgacuccagcuucuuccacagacuggacgacuccuuccugaucccggaggacaagcgcggcagcaaguaucccaucuuugccacccucgccgaggagaaggaguaccacaagcaguuccccaccaucuaccaccuccggaagcagcuggcggacucuaaggagaagaccgaccuccgccugaucuauuuggcccucgcccacaugaucaaguaccggggccacuuccuguacgaggacacguucgacaucaagaacaacgacauccagaagaucuucagcgaguucaucuccaucuacgacaacaccuucgaggggagcucccugagcggccagaacgcccagguggaggcgaucuucaccgacaagaucuccaagagcgccaagcgcgagaggguacucaagcuauuccccgacgagaaguccaccggacuguucagcgaguuccuaaagcugaucguaggcaaccaggccgacuucaagaagcacuucgaccugggggagaaggccccgcuccaguucuccaaggacacguacgacgaggaccuggagaaccugcucggccagauuggcgacgacuucgccgaccuguuccugguggcgaagaagcucuacgacgccauucugcugagcgggauccucacugugacggaccccagcaccaaggcgccccuguccgccagcaugaucgagcgcuacgagaaccaccagaaggaccuggccguccucaagcaguucaucaagaacaaccugcccgagaaguacgacgagguguucuccgaccagagcaaggacggcuacgccggauacaucgacggcaagacgacccaggaggccuucuacaaguacaucaagaaccugcucuccaaguucgagggcacugacuacuuccuggaaaagaucgagcgggaagauuuccugcgcaagcaacggaccuucgacaacgggagcaucccgcaccagauccaccuccaggagaugaacgccauccugcgccgccagggcgagcacuaccccuuccugaaagacaacaaagagaagauagagaagauccucacguucagaauccccuauuacguggggccccuggcccgcggcaaccgggacuucgccugguugacccgcaacuccgacgaggcgauccggccguggaacuucgaggagauagucgacaaggccagcuccgccgaggacuucaucaacaagaugaccaacuaugaccucuaccugcccgaggaaaaggugcugcccaagcacagccugcucuacgagaccuucgccguguacaacgagcugacgaaggucaaguucaucgccgaggggcugcgcgacuaucaguuccucgacuccggccagaagaagcagaucgugacccagcuguucaaggagaagcggaaggugaccgagaaggacaucauccaguuccugcacaacgucgacggcuacgacgggaucgagcucaagggcaucgagaagcaguucaacgcgagccuguccaccuaccacgaccugcucaagaucaucaaggacaaggaguucauggacgacagcaagaacgaagagauccuggagaacaucgugcacacgcugaccaucuucgaggaucgcgagaugaucaagcagcggcucgcccaguacgacucccuguucgacgagaaggugaucaaggcccugauccgccggcacuacaccggguggggcaagcucagcgccaagcugaucgacgggaucugcgacaagcagaccggcaacacgauccuggacuaccucaucgacgacggcaagaacaaccgcaacuucaugcagcuaaucaacgacgacgggcuguccuucaaggagaucacccagaaggcgcaggucgugggcaagaccgacgacgugaagcaggucgugcaggagcuccccgggagcccggccaucaagaagggcauccugcaguccaucaagaucgucgacgagcuggugaagguaaugggucacacccccgagagcaucgucaucgagauggcccgggagaaccagacgaccgcccgcggcaagaagaacagccagcagcgguacaagcgcaucgaggacgcccucaagaaccuggcguccggccuggacagcaacaucuuaaaggagcaccccaccaacaacauccagcuccagaacgaucggcuguuccucuacuacuugcagaacgggcgcgacauguacaccggcaagccccuggacaucaaccagcucuccagcuacgacaucgaccacaucgugccgcaggccuucaucaaggacgacucccuggacaaccgcgugcugaccagccucaaggacaaccgcgggaaguccgacaacguccccagcaucgagguggugcagaaacgcaaggccuucuggcagcagcugcuugacuccaagcucaucagcgagcggaaguucaauaaccugacaaaggccgagcgcggcggccuggacgagcgggacaaggucggguucaucaagcgccagcucguggagacccggcaaaucaccaagcacguggcccagauccuggacgcgcgcuucaacaaggaggucaacgagaaggacaagaaaaaccggaccgugaagauaaucacgcugaaguccaaccucgugagcaacuuccgcaaggaguuccggcuguacaagguccgcgagaucaacgacuaccaccaugcccacgacgccuaucugaaugccgugguggccaaggcgauccucaagaaguaccccaagcuggagcccgaguucgucuacggcgacuaccagaaguacgaccugaagagauacaucucccgcagccggaacccgaaggagguggaaaaggccaccgagaaguacuucuucuacuccaaccuccugaauuucuucaaggaggaggugcacuacgccgacgggaccaucgucaagcgcgagaacaucgaguacagcaaggauaccggcgagaucgccuggaacaaggagaaggacuucgcgacgaucaagaaggugcuguccuacccccaggugaacaucgucaagaagcgagaggugcagacugggggcuucagcaaggagagcauccuccccaagggcaacuccgacaagcugaucccccgcaagaccaaggacauccugugggagaccacgaaguacgggggcuucgacagcccggugaucgccuacuccauccuccugaucgccgacaucgagaaggggaaggccaagaagcugaagaccgugaagacccucgugggcaucaccaucauggagaaggccgcguucgaggagaaccccaucacguuccuggagaacaagggguaccacaacgugagaaaggagaacauccugugccuccccaaguacagccuguucgagcuggagaacggccgccggcgccuccuggcuuccgcgaaggagcuccagaagggcaacgagaucguccucccgguauaccugaccacccugcucuaccacagcaagaacgugcacaagcuggacgagcccgagcaccuggaguacauccagaagcaccguaacgaguucaaggaccuccugaaccugguaagcgaguucagccagaaguacgugcucgccgacgccaaccuggagaagauccagaaccuguacgcggacaacgagcaggccgacaucgagauccucgccaacuccuucaucaaccugcugaccuucacggcccucggugcccccgcggccuucaaguucuucggcaaggacaucgaccgcaagcgcuacaccaccgugagcgagauccugaacgccacgcugauccaccaguccaucacgggccucuacgagacccggaucgaccugagcaagcugggcgaggacuga

SEQ ID NO: 7790 - RNA, 4116 nt, Artificial Sequence
  Cas9 variant
auggacaagaaguacagcaucggccuggacaucgggacuaacucagugggcugggccgucaucaccgaugacuacaaggugcccagcaagaaguucaaagugcucgggaacacggaccgccacuccauuaagaaaaaccugaucggcgcccuccucuucgacagcggggagacggcggaggccacccggcugaagaggaccgcccggcgccguuacacgcgacgcaagaacagaauccgguaccugcaggagaucuucucgagcgaaauguccaaggucgacgacagcuucuuccacaggcucgaggaguccuuccugguggaggaggacaagaagcacgagcggcacccgaucuucggaaacaucguggacgaggucgccuaccacgagaaguacccaaccaucuaccaucuccgcaagaagcucgccgacucuaccgauaaggcggaccugcggcugaucuaccucgcccuggcccacaugauaaaguuccgcggccacuuccucaucgagggggaccucaaccccgacaacuccgacauggacaagcuguucauccagcuggugcaaaccuacaaccagcuguucgaggagaaccccauuaacgcuagccggguggacgcgaaggccauccuguccgcccgccugagcaagucccggcgccucgagaaccugaucgcccagcugccgggugagaaacggaacgggcuguucggaaaccugaucgcccugagccucggacuaacgcccaacuucaagaguaacuucgaccuggcggaggacgcgaagcuccagcugagcaaggacaccuacgacgacgaccuggauaaucuccuggcccagaucggcgaccaauacgccgaccuguuccucgccgcgaagaaccuguccgaugcuauccugcucagcgacauccuucgcgucaauuccgagaucaccaaggcgccccugagcgccagcaugaucaagcgguacgacgagcaccaccaggaccucacccugcugaaagcccucguacgccagcaacugcccgagaaguacaaggagaucuucuucgaccaguccaagaacggcuacgcgggguacaucgacggcggcgccucucaggaggaguuuuacaaguucaucaagccgauucuggagaaaauggacggcacggaggagcugcuggccaagcugaaucgcgaggaccugcuccggaagcagcgcaccuucgacaacggcuccaucccucaccagauccaccugggggaguugcacgccauccuccggcgccaggaggacuuuuaucccuuccugaaggacaaccgggagaagaucgagaagauccugaccuuucgcauucccuacuacgugggcccgcucgcccgggggaauagccgcuucgcguggaugacccggaaguccgaggagacgaucacccccuggaacuucgaggaggucguggacaagggcgcgagcgcccaguccuucauugagcgcaugaccaacuucgacaagaaccugcccaacgagaaggugcugccuaagcacagcuugcuguacgaguauuucaccgucuacaacgagcugacgaaggugaaguacgugacagaagggaugcgaaagccggaguuccucuccggcaagcaaaaggaggccaucgucgaucugcuguucaagaccaaccgcaaggugaccgugaagcaguuaaaggaggacuacuucaagaagaucgaaugcuucgacagcgucgagaucuccggcguggaggaccguuucaacgcgucacugggaacguaccacgaccuucucaagaucaucaaggauaaggacuuccuggacaacgaggagaacgaggauauccuggaggacaucgugcucacccugacccuguuugaggacaaggagaugaucgaggagcgccucaagaaguacgccaaccuguucgacgacaaggucaugaagcagcucaagcggcgccacuacaccggcugggggaggcucucccgcaagcugaucaacggcauacgggacaagcaaagcgggaagacgauucuggacuuccucaagagugacggcuuugccaaucgcaacuucaugcagcugaucaacgaugacagccugaccuucaaagaggccauccagaaggcccagguguccggccaggggcacagccuccacgagcagaucgcgaaccuggccggcagcccggccaucaagaaggggauccugcagagugucaaggugguggacgagcucgucaaggugaugggccacaagcccgagaacaucgugaucgagauggcccgcgagaaccagaccacccagaaggggcagaagaacagccgggagcgcaugaagcggaucgaggagggcaucaaggagcugggcucccagauccucaaggagcaccccgucgagaauacgcagcuccagaacgaaaagcuguaccuguacuaccuccagaacggccgcgacauguacguggaccaggagcuggauauuaaccggcugagcgacuacgacguggaccacaucguaccgcaguccuucaucaaggacgacagcaucgacaacaagaucuugacccgcuccgauaagaaccgggguaagagcgacaacgugcccuccgaggagguggucaagaagaugaagaacuacuggcgccagcugcugaacgccaagcucaucacccagcggaaguucgauaaccucaccaaggcggagcgcgggggccuaagcgagcuugacaaagccggcuucaucaagcggcaguugguggagacgcgccagaucaccaaacacguggcccagauccuggauucccggaugaacaccaaguacgacgagaacgacaaacucauccgcgaggucaaggugaucaccuuaaagucuaagcugguguccgacuuccggaaagacuuccaguucuacaagguccgcgagaucaacaacuaccaccacgcccacgacgccuaccucaacgcggugguggggaccgcccugaucaagaaguacacgaagcuagaaagcgaguucgucuacggcgacuacaagguguacgacguccggaagaugaucgccaaguccgagcaagagaucgggaaggccacugcgaagcgcuucuucuacagcaacaucaugaacuucuucaagaccgagaucaccuuggccaacggcgaaauacggaagcgcccacugaucgagacgaacgaggagaccggggagaucgucugggacaagggccgggacuucgcuaccguacgcaaggugcuguccaugccucaggucaacaucgugaagaaaaccgaggugcagacgggcgcccucaccaacgagagcaucuacgcucgcgggagcuucgacaaacugauauccagaaaacaccgcuuugagagcuccaaguacggcggguucggcucuccgacuguaaccuacuccgugcugguggucgcaaagagcaaggugcaagaugggaaggugaagaaaaucaagacgggcaaggagcucaucggcaugacacugcuggacaagcucgucuucgagaagaacccccugaaguucaucgaggacaagggguacggcaacgugcagaucgacaagugcaucaagcugcccaaguacucccucuuugaguuugaaaacgggacccggcgcaugcuagccagcgugauggccaacaauaacagccggggcgaccugcaaaaggccaacgagauguuccuccccgcgaaacugguuacccugcucuaucacgcgcacaagaucgagagcuccaaggagcuggagcacgaggccuacaucuuagaccacuacaaugaccucuaccagcugcugucauacaucgagcgcuucgccucccucuacguggacguggagaagaacaucagcaaggucaaggaacuguucuccaacaucgagagcuacuccaucagcgagaucuguuccagcgugaucaaccugcucacgcugaccgccagcggagccccggcggacuucaaguuccugggcaccacuaucccccgaaagcgcuauggcagcccccaguccauccucuccagcacgcugauccaccaguccauaaccgggcuguacgagacucggaucgaccucagccagcugggcggggacuga

SEQ ID NO: 7791 - RNA, 4116 nt, Artificial Sequence
  Cas9 variant
auggacaagaaguacagcaucggacuagauaucgggaccaacuccguuggcugggccgugaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcgcggcgccgguacacgcgccggaagaaccgcauccgguaccugcaggagaucuucuccagcgagauguccaaggucgacgacagcuucuuccaccgccucgaggaauccuuccugguggaagaagacaaaaagcaugagcggcaccccaucuucggcaacaucguggacgaggucgccuaccacgaaaaguaccccaccaucuaccaccuccgcaagaagcucgccgacagcaccgacaaggcggaccugcggcugaucuaccucgccuuggcccacaugauuaaguuccgcggccacuuucugaucgagggggaccucaaccccgacaacuccgacguggacaaacucuucauccagcuggugcaaaccuacaaccagcuguucgaggagaaccccaucaacgccagccgggucgacgcgaaggccauccuguccgcccgccugagcaagucccggcgccucgagaaccugaucgcccagcugccgggcgagaagcggaacggucucuucgggaaccugaucgcccucagccucggucugacgcccaacuucaaguccaacuucgaccuggcggaggacgccaagcuccagcugagcaaggacaccuacgaugacgaccuggacaaccuccuggcccagaucggcgaccaguacgccgaccuguuccucgccgcgaagaaccuguccgacgccauccugcucagcgacauccugcgcgugaacucugagauaaccaaggccccgcuguccgccagcaugaucaagagguacgacgagcaccaccaggaccucacgcugcugaaggcccucgugcgccagcagcugcccgagaaguacaaggagaucuucuucgaccagagcaagaacggcuacgcggguuauaucgacggcggggccagccaggaggaguucuacaaguucaucaagccgauccuggaaaagauggacggcacggaggagcuccuggccaagcugaaccgcgaggaccugcuccggaagcagcgcaccuucgauaacggcuccaucccccaccagauccaccugggggagcugcacgccauccuccggcgccaggaggacuucuaccccuuccugaaggacaaccgggagaagaucgagaagauccugaccuuccgcauacccuacuacgucggaccgcucgcccgggggaacagccgcuucgcguggaugacccgaaaguccgaggagacgaucacccccuggaacuucgaggaggugguggacaagggcgccagcgcccagaguuucaucgagcgcaugaccaacuucgacaagaaccugcccaaugagaagguccugcccaagcacagccuccuguacgaguacuucaccguguacaaugagcugacgaaggugaaguacgucaccgaggggaugcggaagccugccuuccucuccggcgagcagaagaaggcgaucguggaccugcuguucaagaccaaccgcaaggugaccgucaagcagcucaaggaagacuacuucaagaagaucgagugcuucgacucuguggagaucuccggcguggaagaccgguucaacgccagccuggggacguaccacgaccugcucaagaucaucaaggacaaggacuuccuggacaacgaggagaacgaggacauccuggaggacaucguccucacccugacccuguucgaggacaaggagaugaucgaggagcggcucaagaccuacgcccaccuguucgacgacaaggugaugaaacagcugaagcggcgccacuacacggguugggggcggcucucccgcaagcucauaaauggcauccgggacaagcagagcgggaagaccauccuggacuuccucaaguccgacggcuucgccaaccgcaacuucauccagcugauccaugacgacagccugaccuucaaggaggccauccagaaggcgcaggucuccggccaggggcacagccuccacgagcagaucgccaaccuggccggcagccccgccaucaagaaggggauccugcaguccgugaaggugguagacgagcucgugaaagugaugggccacaagcccgagaacaucgucaucgagauggcccgcgagaaccagaccacgcagaaggggcagaagaacagccgggagcgcaugaagcggaucgaggagggcaucaaggagcugggcucccagauccugaaggagcaccccguggagaacacccagcuccaaaacgagaagcuguaucuguacuaccuccagaacgggcgcgacauguacguggaccaggagcuggacaucaaccggcugagcgacuacgacguggaccauaucgugccgcaguccuucaucaaggacgacagcaucgacaacaaagugcucacccguuccgacaagaaccggggcaagagcgacaacguccccuccgaggagguggugaagaagaugaagaauuauuggcgccaguugcugaacgcgaagcucauuacccagcggaaguucgacaaccugacgaaggccgagcgcgggggccugagcgagcucgauaaggccggcuucaucaagcggcaauuagucgagacccgccagaucaccaagcacguggcccagauccuggacucccggaugaacaccaaguacgacgagaacgacaaacucauccgcgaggugaaggucaucacccucaagagcaagcugguguccgacuuccggaaggacuuccaguucuacaaggugcgcgagaucaacaacuaccaccacgcccacgacgcguaccucaacgccgucguugggacggcccugaucaagaaguaccccaagcuggagagcgaguucguguacggcgacuacaaggucuacgacgugcggaagaugaucgccaaguccgagcaggagaucgggaaggcaaccgccaagcgcuucuucuauagcaacaucaugaacuucuucaagaccgagaucacccucgccaacggcgagauccggaagcgcccccugaucgagacgaacgaggagaccggggagaucgugugggacaagggccgggacuucgccacuguccgcaaggugcuguccaugccccaggugaacaucgucaagaagaccgaggugcagacgggcgcccucaccaacgagagcaucuacgcgcgcggguccuucgacaagcugaucucccggaagcaccgcuucgagagcuccaaguacggcggguucggcagccccaccgugaccuacuccguccuggugguggccaagagcaagguccaggacgggaaggugaagaagaucaagacgggcaaggagcucaucggcaucacccugcuggacaagcucguguucgagaagaacccccugaaguucaucgaggacaagggguacggcaacgugcagaucgacaagugcaucaagcugcccaaguacucccuguucgaguucgagaacgggacccggcgcaugcuggccagcgugauggccaacaacaacucccgaggcgaccugcagaaggccaacgagauguuccucccggcgaagcuggugacccugcucuaccacgcccacaagaucgagagcuccaaggagcuggaacaugaggccuacauccuggaccacuacaaugaccucuaccagcugcugagcuacaucgagcgcuucgcgucccucuacgucgacguggagaaaaacaucagcaaggugaaggagcuguucuccaacaucgagagcuacuccaucucggagaucuguuccagcgucaucaaccugcucacgcugaccgccagcggggcgcccgccgacuucaaguuccugggcaccaccaucccccggaagcgcuacggcuccccgcaaagcauccucuccagcacgcugauccaccaguccaucaccggacuguacgagacccggauugaccucagccaacugggcggggacuga

SEQ ID NO: 7792 - RNA, 4116 nt, Artificial Sequence
  Cas9 variant
auggagaacaagaacuacagcaucggccuggacaucgggacuaacuccgugggcugguccguaaucaccgacgacuacaaggugcccuccaagaagaugaaggugcucgggaacacggacaagcacuucaucaagaagaaccugaucggcgcccugcuguucgacgaggggaccaccgccgaggcgcgccggcugaagcgcaccgcccggcgccgguacacgcgccggaagaaccgccugcgguaccuccaggagaucuucagcgaggaaaucggcaaagucgacuccagcuucuuccaccgccuggacgacuccuuccugauccccgaggacaagcggggcagcaaguaccccaucuucgccacccucgccgaggagaagaaguaccacaaacaguuccccaccaucuaccaccuccgcaagcagcuugccgacuccaaggagaagaccgaccuccggcugaucuaccuggcgcuugcccauaugaucaaguaccgcgggcacuuccuguacgaggaggccuucgacaucaagaacaaugacauccagaagaucuucaacgaguucaucagcaucuauaauaacacauucgaaggcaacucccugagcgggcagaauguccaggucgaggccaucuuuaccgacaagaucuccaagagcgcgaagcgggagcgcgugcucaagcuguuccccgacgagaaguccaccgggcuguucucagaguuccucaagcugaucguggggaaccaggccgacuucaagaagcacuucgaccuggaggagaaggcuccgcuccaguucucccgggacaccuacgacgaggaccuggagaaccugcucggccagaucggagacgacuucgccgaccuguuccugguggccaaaaagcucuacgacgcgauccugcugagcgggauccucacggucaccaaccccuccaccaaggccccgcugagcgccagcaugauugaacgcuacgagaaccaccagaaggaccuggcuagucucaagcaguucaucaagaacaaccugcccgagaaguacgacgagguguucagcgaccagucggaggacggcuaugccggguacaucgacggcaaaaccacgcaggagaccuucuacaaguacaucaagaaccugcucagcaaguucgagggcgcggacuacuuccuggacaagaucgagcgggaggacuuccugcgcaagcagcggaccuucgacaacggguccaucccgcaccagauccaccuccaggaaaugaacgccauccugcgccgccagggcgagcacuaccccuuccugaaggagaacaaggaaaagaucgagaagauccuuaccuuccggauacccuacuacguggggccccuggcccgcgguaaccgggacuucgccuggcugacgcgcaacagcgaccaggccauccggccguggaacuucgaggagaucgucgacaaggcguccagcgccgaggauuuuaucaacaagaugaccaacuacgaccucuaccugcccgaggagaaggugcugcccaagcacucccugcucuacgagaccuucgccguguacaacgagcugacgaaggucaaguucaucgccgaggggcugcgcgacuaccaguuccucgacagcggccagaagaagcagaucgugacgcagcuguucaaggagaagcggaaggugaccgagaaggacaucauccaguuccugcacaacgucgacggcuacgacgggaucgagcucaagggcaucgagaagcaauucaacgccucccugagcaccuaccacgaccugcucaagaucaucaaggacaaggcguucauggaugacgccaagaacgaggccauccuggagaacaucgugcacacccugacgaucuucgaggaucgcgagaugauuaagcagcggcucgcccaguacgacucccuguucgacgagaaggugaucaaggcgcugacccgccggcacuacaccggguggggcaagcucagcgccaagcugaucaaugggaucuccgacaagcagaccggcaacacgauccuggacuaccucaucgacgacggcgagauuaaccgcaacuucaugcagcugaucaacgacgacgggcugagcuucaaggagaucauccagaaggcccaggucgugggcaagaccaacgacgugaagcaggucguacaggagcuccccggguccccggccaucaagaagggcauccugcagagcaucaagaucgucgacgagcuggugaagguaauggggcacgccccggaauccaucgucaucgagauggcgcgggagaaccagaccaccgcccgcggcaagaagaacagccagcagcgguacaagcgcaucgaggacagccucaagauccuggccuccggccugaacagcaagauccucaaggagcaccccacggacaacauccagcugcagaacgaccggcuguuccucuacuaccugcagaacgggaaggacauguacaccggcgaggcccuggacaucaaccagcucuccagcugcgacaucgaccacaucaucccgcaggccuucaucaaggacgauagucuagacaaucgcgugcuaaccagcuccaaggacaaccggggcaagagcgacaacgugccgucccucgaggucguagacaagaugaagguguucuggcagcagcugcuggacagcaagcucaucuccuaccgcaaguucaacaaccugacgaaggcggagcgcgggggccugaacgagcucgacaaggucggguucaucaagcggcagcugguggagacccgccagaucacgaagcacguggcccagauccuggacgcccgguucaacaaggagguaaccgagaaggacaagaagaaccgcaccgugaagauaaucacacucaagagcaaccugguguccaacuuccggaaggaguucgagcuguacaaaguccgcgaaaucaacgacuaccaccacgcccacgacgccuaccucaacgcagugguggccaaggccauccugaagaaguaccccaagcuggagcccgaguucguauauggcgacuaccagaaguacgaccucaagcgguacaucucgcgcuccaaggaccccaaagagaucgagaaggccacggagaaguacuucuucuacagcaaccugcugaacuucuucaaggaggaggugcacuacgcggacgggaccaucgugaagcgggagaacaucgaguacuccaaggacaccggcgagaucgccuggaacaaggagaaggacuucgccaccaucaagaagguccucagccugccccaggugaacaucgugaagaagcgcgagguacagaccgggggcuucagcaaggagucaauccugcccaagggcaacagcgacaagcucaucccccgcaagacgaaggacauccuuugggauaccaccaaguacgggggcuucgacucccccgugaucgccuauagcaucuuacucaucgccgacaucgagaaggggaaggcgaagaagcugaagaccgugaaaacccuggucggcaucaccaucauggagaaggacgccuucgagaaaaacccgaucgccuuccuggagaacaagggguaccacaacgugugcaaggaaaacauccugugccugcccaaguacucccucuucgagcuggagaacggccgccggcgccugcuagccagcgccaaggagcugcaaaagugcaacgagaucgugcugcccgucuaccucaccacgcugcuguaccacucaaagaacgugcacaagcucgacgagccgggccaccuggaguacauucagaagcaccggaacgaguucaaggaccugcucaacuugguguccgaguucucccagaaguacguccuggcggacgccaaccucgagaagaucaagaaccuguacgccgacaacgagcaggccgacaucgagauccuggccaacagcuucaucaaccuccugaccuucaccgcgcugggggcccccgccgccuucaaguucuucggcaaggacguggaucgcaagcgguacaccacgguguccgagauccucaacgcgacccugauccaccagagcaucaccgggcuguacgagacccgcaucgaccucuccaagcugggcgaggacuga

SEQ ID NO: 7793 - RNA, 4116 nt, Artificial Sequence
  Cas9 variant
augaaaguaaacaacuaccacaucgggcuggauauuggaaccagcuccaucgguuggguugcgaucggggaggacgggaagccccugcguaucaaggggaagaccgccaucggcgcgcgccuguuccaggagggcaacccggccgcagaccgccgcauguuccgcacaacccggagacgucugucacgacggaaguggcgucucaagcugcuugaggagaucuucgacccguauaucacccccguugacucuaccuucuucgcccggcucaagcagagcaaccuuucccccaaggacagccgcaaggaguucaagggauccaugcuguuuccggaccucaccgacaugcaguaccacaaggacuaccccaccaucuaccaccuccggcacgcccugaugacccaggaugaaaaguucgacauccgcaugguguaccuggcgauccaccacaucgucaaguaccgcggaaacuuccucaacagcacacccguagacuccuucaaggcuagcaaagugaauuucgucgaucaguucaagaaacugaaugagcucuacacagcuaucaaucccgaggaguccuuccagaucaaccuggccaacagcgaagacaucggacaccaguuccuggacccguccauccgcaaguucgacaaaaagaagcaaauccccaagaucgugccugugagcgucgacgacaaggcgaccgacaagaucaacggaaaaaucgccuccgagaucaucaacgccauccucggguacaagaguaagcuggauguggugguccaaugcacccccguggacuccaagagcugggcccugaaguucgaugaggaggacaucgaugccaagcuccagaagauacugccggagauggacgagaaccagcaguccaucaucgcaauccugcaaaaccucuacagccagguaacacugaaccagauuguucccaauggcaugagccuguccgagagcaugauagagaaguacaacgaccaccacgaccaccucaagcuguacaagaagauaaucgaccagcuggccgaccccaaaaagaaggccgcccucaagaaggccuacucccaauacgugggcgacgacgggaagguaaucgagcaggcggacuucuggagcuccgucaaaaagaaccuggaugacagcgaccuguccaagcagaucauggacuugauugacgccgagaaguucaugccaaaacagcggacgagccagaacggcgugaucccgcaccagcugcaccagcgcgagcuggacgaaaucaucgaacaccaguccaaguacuaccccuggcucgccgagaucaaccccaacaagcacgaccugcaccuggcgaaguacaagaucgaggagcucguggccuuccggguccccuacuacguugggccgaugauuacccccgacgaccaagccaagagcgcggaaaccguguucuccuggauggagcgcaagggcaaggaggccggccagaucaccccauggaacuucgacgagaaggucgaccggaacgccagcgccaacagauucaucaagcgcaugacgaccaaagacaccuaccugaucggggaggacgugcugcccgacgagucccuccuguacgagaaguucaagguucugaacgagcucaacaugguuagggugaacggcaagcugcugaagguagcggacaaacaggcaaucuuccaggaccucuucgagaacuacaagcacaucagcgugaagaagcugcagaauuacaucaaguccaagaccggacugccgagcgaccccgaaaucuccggccugagcgaccccgaguacuucaacaacucccucgggacguacaacgacuucaagaaacucuucgguaacaagguggacgaacccgacuuacaggacgacuucgagaagaucgucgaguggaguacgguguucgaggacaagcgcauccuccgggagaagcugaacgagauaaccuggcuaagcgaucagcagaaagacgugcucgaguccagccgcuaccagggcugggggcgguuauccaagaagcugcucaccggaauugucaacgaccagggggagcgcaucaucgacgaguuguggaacacgaacaagaacuucaugcagauccagagcgacaacgacuucgccaaacggauacacgaggccaacgcggaccagaugaaggcuguggacgucgaggacguccuggccgacgccuacaccagcccccagaauaagaaggccauccgccagguggucaaggucguggacgacauccagaaggcgaugggcggggucgcccccaaauauaucucaaucgaguucacccgguccgaggaccgcaauccccggcgcaccaucagccggcagcgccagcucgaaaacacguugaaggacaccgcaaagucccuggccaagagcaucaacccggagcucuuauccgagcuggacaacgcagccaagagcaagaagggccucaucgaccggcuguaucuuuauuucacccagcucggcaaggacaucuacacggguaagcccaucaacaucgacgagauuagcacauacgacauagaccauauucuuccccaagcguucgucaaggacgacagccuaaacaaccgcgugcucguguccaaggccaucaacaacgggaaaagcgacaauguccccguucaguuguucggggccaagaugggccauuucuggaaacagcuggccgaggcagggcucaucuccaagcgcaagcugaagaaccugcagaccgauccggacaccauuagcaaguacgccaugcacggcuucauccgcagacagcucguggagacaagccaggucauaaaauugguggcuaacauccugggcgacaaauaccgaaaugacgacacgaagaucaucgagaucaccgcccguaugaaccaucaaaugcgggaugaguucggguucauaaagaaccgcgagaucaacgacuaccaucacgcauuugacgccuaccucaccgccuuccucggccgguaccuguaucaccgcuacaucaagcuccggcccuacuuuguuuacggggacuuuaagaaguucaaagaggacaaagucaccaugcgcaacuuuaacuuccugcacgaccugaccgacgacacgcaggagaagauagcugacgccgagacgggcgaggugaucugggaccgggagaacuccauccagcagcucaaggacguguaccacuacaaguucaugcugaucagccaugaggucuacacccugaggggcgcgauguuuaaccagacgguguaucccgccuccgacgccggcaagcggaagcucauacccaucaaggccgaccgcccgaucaacguguacggcggauacagcggcuccgccgacgcuuacauggccaucguacggauccauaacaaaaagggggacaaguaccgcgucgugggcgucccuaugcgggcccgcgaccggcuggacgccgccaaaaaggugagcgacgcggacuacgaccgcgcccugaaggacguccucacuccccaacugaccaagaccaagaagucgcggaagaccggcgagaucacccaggucguggaggacuuugagauugugcuggggaaggucauguaccgacaguuaaugaucgacggcgacaagaaguucaugcuggggagcuccaccuaccaguacaacgccaaacaguugguguugagcgaccaguccgugaagacccuggccagcaagggccggcuggacccccuccaagaguccauggacuacaacaacgucuacaccgagauccuggacaaagugaaccaguacuucagccuguacgauaugaacaaguuccgccauaagcugaacuuaggguucagcaaguucauauccuucccgaaccacaacguguucgacggcaacacgaaagcguccagcgguaagcgggagauccuagaggagguccucaacgggcugcacgccaaccccaccuucggcaaccugaaggacaucgggauaacuacccccuuuggccaacuccagcagcccaacgguauccugcuguccgaugaggcgaaaaucagauaccaguccccgacgggccucuucgagcgcaccgugagccugaaggaccuguga

SEQ ID NO: 7794 - RNA, 4116 nt, Artificial Sequence
  Cas9 variant
augaaggugaacaacuaccacaucggccuggacaucgggaccagcuccaucggcugggucgccaucgggaaggacggcaagccccuccgcgugaaggguaagaccgccauaggcgcgcggcuguuccaggagggcaacccggccgccgaccgccggauguuccgcacgacccgccgccggcuuagccgccggaaguggcgccucaaguugcuggaggaaaucuucgaccccuacaucacccccguggacuccaccuucuucgcccggcucaagcagagcaaccugucccccaaggacagccgcaaggaguuuaaggggagcaugcuguucccggaccucacggacaugcaguaccacaagaacuaccccaccaucuaccaccuccggcacgcccugaugacccaggacaagaaguucgacauccgcauggucuaccuggccauccaccacaucgugaaguaccggggcaacuuccugaacucaacccccguggacuccuucaaggccagcaaggucgacuucguggaccaguucaagaagcugaacgagcucuacgccgccaucaaccccgaggaguccuucaagaucaaccuggcgaacagcgaggacaucgggcaccaguuccuggacccguccauccgcaaguucgacaagaagaagcagauccccaagaucgugcccgucaugaugaacgacaaagugacggaccggcuaaacggcaagaucgccagcgagaucauccacgccauccugggguacaaggccaagcuggacgugguccuccagugcaccccgguggacuccaagccgugggcccugaaguucgacgacgaggacaucgacgcgaagcuggagaagauccuccccgagauggacgagaaccagcagagcaucguggccauccugcagaaccuguacucccaggucacccucaaucagaucgugcccaacggcaugagccuguccgagagcaugaucgagaaguacaacgaccaccacgaccaccugaaacuuuacaagaagcugaucgaccagcuggccgaccccaagaagaaggccgugcucaagaaggccuacagccaguacgucggcgacgacgggaaggugaucgagcaggcggaguucugguccagcgugaagaagaaccuggaugacuccgagcugagcaagcagaucauggaccucaucgacgccgaaaaguucaugccaaagcagcgcaccucccagaacggcgucaucccccaucagcugcaccagcgggagcuggacgagaucauugagcaccagagcaaguacuaccccugguuaguggagaucaaccccaacaagcacgaccugcaccuggcaaaguacaagaucgaacagcucguggccuuucgcgucccguacuacguggggcccaugaucacgcccaaagaccaggccgagagcgcggagaccgucuucagcuggauggagcggaaggggaccgagaccggccagaucacgcccuggaauuucgacgagaagguggaccgcaaggccuccgccaaccgcuucaucaagcggaugaccaccaaggacaccuaccugaucggggaggacgugcugccugacgagagccuccuguacgagaaguucaagguccuaaacgagcucaacaugguacgcgugaacggcaagcugcugaaggucgccgacaagcaggccaucuuccaggaccuguucgagaauuacaagcacguguccgugaagaagcuccagaacuacaucaaggcgaagacggggcugcccagcgaccccgagauauccggccugagcgaccccgagcacuucaacaacucccucgggaccuacaacgacuucaagaagcuguucgguagcaaggucgacgagccggaccugcaggacgacuucgagaagaucguggagugguccacgguguucgaggacaagaagauccuccgggagaagcugaaugaaaucaccuggcucagcgaccaacagaaggacgugcucgaguccagccgcuaccagggcugggggcggcugagcaagaagcugcucacgggcaucgugaacgaccagggggagcgcaucaucgacaagcuguggaacaccaacaagaacuucaugcagauccaguccgacgacgacuucgccaagcggauccacgaggccaaugccgaccagaugcaggcggucgacgucgaagacgugcuggccgacgccuacaccagcccccagaacaagaaggccauucgccagguggucaaggugguggacgacauccagaaggcaaugggaggggucgcgcccaaguacaucaguaucgaguuuacccggagcgaggaccgcaacccgcggcgcacgaucucccggcagcgccaacucgagaacacccugaaggacaccgccaagagccuggccaaguccaucaaccccgagcuccugagcgaacuggacaacgccgccaaguccaagaagggccucaccgaccggcuguaccuguacuucacgcagcucggcaaggacauauacaccggggagcccaucaacaucgacgagcuaaacaaauacgacaucgaccacauccugccccaggcguucaucaaggacaacagccucgacaaccgcgugcuggugcugaccgccgucaacaacggcaaguccgacaacgugccgcuccggauguucggggccaagaugggccauuucuggaagcagcuggccgaggccgggcugaucagcaagcgcaagcucaagaaccugcagaccgaccccgacacgaucuccaaguacgcgaugcacggcuucauccggcgccagcugguggagaccagccaggucauaaaguuaguggccaacauucugggcgacaaguaccgcaacgacgacaccaagaucaucgagaucaccgcccggaugaaccaccagaugcgcgacgaguucggguucaucaagaaccgggagaucaacgacuaccaccacgccuucgacgcguaccuuaccgccuuccucggccgauaccuguaccaccgguacaucaagcugcgccccuacuucguguacggggauuucaagaaguuccgggaggacaagguuacgaugcgcaacuucaacuuccuccacgaccugacugacgacacacaggagaagaucgccgacgccgagaccggcgaggugaucugggaccgggagaacuccauccagcagcugaaggacguguaccacuacaaguucaugcucaucagccacgaggucuacacgcugcgcggcgccauguuuaaucagaccguguaccccgcguccgacgccgggaagcggaagcugaucccggugaaggccgaccgccccgugaacguguacggcggguacagcggcagcgccgacgccuacauggcgaucgugcggauccacaacaagaagggcgacaaguaccgcguugugggcgugcccaugcgggcccucgaccgccuggacgccgccaagaacgucuccgacgccgacuucgaccgggcgcugaaggacgugcucgcgccccagcuuaccaagaccaagaagucccgcaagacgggcgagaucacccaaguuaucgaggacuucgagaucguacucgggaaggugauguaccggcagcucaugaucgacggcgacaagaaguucaugcuggggagcagcaccuaccaguacaacgcgaagcaacuggugcucuccgaccagagcgucaagacccucgccuccaagggcagacuggacccguuacaggagagcauggacuacaacaacguguacacagaaauccuggacaaggugaaccaguacuucucccuguacgacaugaacaaguuccggcacaagcucaaccugggguucagcaaguucaucuccuuccccaaccacaacgugcuggacggcaacacaaaggugagcuccggcaagcgcgagauccuucaggagauccugaacgggcugcacgcuaaccccaccuucggcaaccucaaggacgucgggauuaccacgcccuucggccagcugcagcagccgaacgggauccugcucagcgacgagaccaagauccgcuaccagucccccaccggccuguucgagcggaccgugucacugaaggaucucuga

SEQ ID NO: 7795 - RNA, 4116 nt, Artificial Sequence
  Cas9 variant
auggacaagaaguacagcaucggccuggacaucgggaccaacuccgugggcugggccgucaucaccgacgacuauaaggugcccagcaagaaguucaaggugcucggcaacacggaccgccacaguaucaaaaagaaccugaucggcgcccugcuguucgacucuggggagaccgcggaggcuacccggcugaagcgcacggcccggcgccgguacacacgucgaaagaaccgcaucugcuaccugcaggagaucuucuccaacgagauggccaaggucgacgauagcuuuuuccaccggcucgaggaauccuucuuaguggaggaggacaagaagcacgagcgccacccgaucuucggcaacaucguggacgaggucgccuaccacgagaaguaccccaccaucuaccaccuccggaagaagcucgcggacagcaccgacaaggccgaccugcgccugaucuaccucgcccuggcgcauaugaucaaguuccggggccacuucuugaucgagggagaccucaaucccgacaacuccgacguggacaagcuguucauccagcuggugcagaccuacaaccagcuguucgaggagaaucccaucaacgcgagccgagucgacgccaaagccauccuguccgcccggcuuagcaaguccagacggcucgagaaccuuaucgcccagcuaccgggcgagaagaagaacggccucuucgggaaccugaucgcgcugagcuuaggucugacgcccaacuucaaguccaacuucgaucuggccgaggacgccaagcuccagcugagcaaggacaccuacgacgacgaccuggacaaccuccuggcccagaucggggaccaguacgccgaccuguuccucgcggccaagaaccuguccgaugccacccugcucuccgacauccuccgcgucaacuccgagauuacgaaagccccgcugagcgccagcaugaucaagcgguacgacgagcaccaccaggaccucacgcuguuaaaggcgcucgugcgccagcagcugcccgagaaauacaaagagaucuucuucgaccagucuaagaauggcuacgcaggguacaucgacggcggggccucccaggaggaguucuacaaguucaucaagccgauccuggaaaagauggacggaaccgaggagcuccuggccaagcugaaccgggaggaccugcugcgcaaacagcgcaccuucgacaacggcuccaucccacaccagauccaccugggggagcuucacgccauccuccggcgccaagaggacuucuaccccuuccugaaggauaaccgggagaagaucgagaagauccugaccuuccgcauccccuacuacgucggcccgcucgcgcggggcaacagccgcuucgccuggaugacgcggaaguccgaggagaccaucacccccuggaacuucgaggaggugguggacaagggugccagcgcccaguccuucaucgaacgaaugaccaacuucgacaagaaccugcccaacgagaagguccugcccaagcacagccuccuguacgaguacuucacgguguacaacgaacugaccaaggugaaguacgucaccgaagggaugcggaagccggcuuucuuguccggcgagcagaagaaggcaaucguggacuuacuguucaaaaccaaccgcaagguuacggucaagcagcucaaggaggacuacuucaagaagauugagugcuucgacagcguugagaucuccggcguggaggaucgauucaacgccagcuuagggaccuaccacgaccugcucaagaucaucaaagacaaggacuuccuggacaacgaggagaaugaggacauccuggaggacaucguccucacccugacccuguucgaggacaaggagaugaucgaggagcgccucaagacguacgcccaccuguucgacgacaaggugaugaagcagcuaaagcggcgacauuacaccggcugggggcggcucucccgcaagcugaucaacggcauccgggacaagcagagcgggaagaccauccuagacuuucucaaguccgacggcuucgccaaccggaacuucauccagcucauccacgacgacagccugaccuucaaggaggcgauccagaaggcucaggucuccggccagggacacucucuccaugagcagaucgccaaccuggccgggucccccgccaucaaaaaggggauccugcagagcgugaaaguggucgacgaguuggugaaggugaugggccacaagcccgagaacaucgucaucgagauggcacgggagaaccagacgacccagaaggggcagaaaaacagccgugagagaaugaagcggaucgaggagggcaucaaggagcugggcucccaaauccugaaggagcaccccguggagaacacccagcuccagaacgaaaagcuguaccuguacuaccuccagaacgggcgcgauauguacguggaccaggaguuagacaucaaccgacugagcgacuaugacgucgaccacaucgugccgcaguccuucauuaaggacgacagcaucgacaacaaggugcucacccgcucggacaagaaucggggcaaaagcgacgacgugcccuccgaggagguggugaagaagaugaagaauuacuggcgccagcugcuuaacgccaagcucaucacgcagcggaaauucgacaaccugacgaaggccgagcgcgguggccugagcgaguuggacaaggccggcuucaucaagcggcagcuggucgagacccgccagaucaccaagcacguggcccagauccuggauucccgcaugaacaccaaguacgacgagaacgacaagcucaucagggaggugaaggucaucacgcucaagagcaagcugguguccgacuuccggaaggacuuccaguucuacaagguacgagagaucaacaacuaccaccacgcgcaugacgccuaccucaacgccguuguggguaccgcgcugaucaagaaauaccccaagcuggagagcgaguucguguacggcgacuacaaggucuacgacgugcggaagaugaucgcgaagagugagcaggagaucggcaaggccaccgccaagcgcuucuucuacagcaacauaaugaacuucuucaagaccgaaaucacgcucgccaacggcgagauacggaagcgcccccugauugagaccaacgaggagaccggggagaucgugugggacaaaggccgggacuucgccaccguuaggaaggugcuguccaugccccagguuaacaucgucaagaagacggaggugcagaccggcgcgcucaccaacgagagcaucuacgcccgcggguccuucgacaagcugauuagccgcaagcaccgcuuugagaguuccaaguacggcggguucgggagcccuaccgugacguacagcguccucgugguggccaagagcaagguccaggaugggaaggugaagaagaucaaaaccggcaaggagcuuaucggcaucaccuuauuggauaagcucguuuucgagaaaaauccccugaaguuuaucgaagacaagggguacgguaacguccagaucgacaagugcaucaagcugcccaaguauucccucuucgaguucgagaacgggacccggcgcaugcuggccagcguuauggccaacaacaacucccggggcgaccugcagaaggcgaacgagauguuccugcccgccaagcuggugacguugcucuaccaugcccacaagauagagagcuccaaggagcuggagcacgaggccuacauccuggaccacuacaacgaccucuaccagcugcugagcuacaucgagcgcuucgccucccucuacgucgacguggagaagaacaucaguaaggugaaggagcuguucuccaacauugagucuuacuccaucagcgagaucugcuccagcgucaucaaccugcuaacccugaccgcuuccggugcccccgcagacuucaaguuccugggcacgacgaucccccggaagcgcuacggcagcccgcagagcauccucucaagcacgcucauccaccaguccaucaccgggcuguacgagacccggauugaccucagccagcugggcuccgacuga

SEQ ID NO: 7796 - RNA, 4119 nt, Artificial Sequence
  Cas9 variant
augaacaacgaguacuucgugggcuucgacaucgggaccaacagcgucggcgccgcugugaccgacgagaaguaccacgugcugaaguucaaggggaaugcgauguggacguccgccgucuucgagagcgcccagcagucugccgaucgccggcucaaccgcaccgcccggcgccggcuggaccgcagccagcagcggcgcgaccugcuucaggagcucaucgcgcccgccaucaccccggucgacccccgguucuucgaccgcauccgggaguccgcccugugggccgaggacaagaccacgggcagccgcuuuaccuacuucuccgacgagggguauaccgacaagcaguaccacaaagaguaccccaccauccaccaccucaucugcagccugaugaacgaccccgcgccgcacgacccccggcugguguacauagccugcuccuacaugcucacgcaccgcggccauuuccugaacgaggccgacaaggagaaaaucgacgacguccuggacauccggcgcguguucaacgagcucugcagcugguucaccuccuacggcaucgaggugcccuuuagcugcuuccccgaggaguucgggaacguccugaccgccaaccggggcgugcaggaccgcacccgggccuucuacgaccuccucuucgcggggaaaaagccgaaacccuccgaggacgaucagguggacaucgacguccugaucaagcugaucagcggcgggaagaucgagcucuccaagcuguuccugaacgaggaguacucggaguuggagaacaauaagauccagcugucagacgccggcuucgacgagaaggagccagagcugcgcagcgagcucggcgacgacuucgggcuaguagccgccgcgaagaacaucuacgacuggucccugcucacgggcgugcugggggagugcaagagcaucagcgaggcgaagguaaagaccuacgagaagcacuccgaggaucuggccgcccucagacgcguggugcgcaaguaccacccagacaaguacaaggagaucuucaagaaguacgucgugggaaacuacaccagcuacuccggcaacgucaagagugccgggaagaucucugagaccaagcugaagcggugcaaccaggccgaguucugcgacuaccucaagagcaaacuuaaggacgugaagccggcgccaggcgacgacgagugcgagcgcgugcugaaggagaucuccaagcacacauucugcccccgccaggugaccacugacaaccggguuauccccuaccagcuguacuacacugagcucaagaaggugcuggagaacgcaaagcgguacauaccgcagcugaacgucacggacgaguaugggagcgccgccgacaagauccucucccugaugaccuuccgcauccccuacuacgugggcccccuggugaagaagaacgacagcuccaacgccuggaucguccggcgcggggagggccggauccucccauggaacuucgacgagcugguggacaaggacaagugcgaggacgaguucauccgccggaugaccugcaagugcaccuacaucgcgggcaagaacgugcugccgaagaacagccuccuguacugcaaguuuaugguccugaacgagaucaacaacaucaagaucaacggggagcgcaucucggugggcgacaagcagaagaucuacacggagcuguucgagaagaagcggaaggugaccguccgcgauauccggaaccugcugaccagcgaggggcgccugaaggccggcgacaccuucgggggcaucgacaucacggugaaguccagccucaagccccagcacgaccugaagcggcugauggccgccggagugaucaccgaggcggacgccgaggagaucaucgagcgcaucacgugcaccaccgacgucucccggcuccgcaccuggcuggggaaguucggccugagcgccgccgacgccaaguacgugucggggcucaaguacagcgacuucggccgccugagccgggaguuccugaccgaggugaacgacgucgaccccgcgaccggggaggugaucaaccccaacaucaucacgaugaugugggagaacaacaucaaccucauggagcugcugucccagaaguacagcuaccgcucccagaucgagagcaugaaccgcgaguacuacgccgccaacccgcucacccuggacgagagaauguccgagauguacauccccagcgccgugcggcgacccgucaagcggaccaucgaaaugaugaaggaguacaugcacaucaugcgcaagcccccgaagcggaucuucaucgagauggcccgcgagcugaccgaccucgacaacaagggcaagcggaccuccagccgccggaacacgcugcuggaguucuucaagaagugcccccaggacaccaccgagcuccgcgcgcagcuggagaagaagagugacgacgagcugcggagcgagaagcucuaccuguacuucgcccagcugggcaagugcauguacuccggggagagcaucgacaucgagcgccucggcuccaagcuguacgacguggaccacaucuucccccaggcccgggugaaggacgacagcaucgagaacaagguccuggugcucuccgaccugaacggggccaagagcgaccgcuacccgaucaacgccgacauucggaacaagaugcacucauucugggacaagcugcacagcaucggccucaucggcgagaagaaguacgagcgccugacccggagcacgggguucaccgacgacgagcuggcgggcuucaucucccgccagcucguggagacccgccagagcaccaaggccgucgccgcccugcuggcggaggaguuccccgaguccgagaucguguacgugaaggccgggcucgccagccaguuccggcacgaguucggcuugcugaagugccgcgagaucaacgaccuccaccacgccaaggacgcauaccugaacaucgucauggggaacaucuaccacgugaaguucacgaaggaccccaugaacuucgugaaggaguacaggcgcaaggagcaggucuucgaccugaagauccaguccaugcucacccacgacgcgauccggaacggcgagaccgccuggaucggcgacgggaccuggcuggagacggugaagaagcagauggagaagaauaacauccgcuacgugcgcuacagcuuccgccggaagggcgcccuguucaaccucaugccggagcgcaaaaacccgucccugcugccaagaaagaacgggaagaacaugguccuccccgccgagaaguacggcggguacaacaacaccgccgcgagcuucuucucccuggugaaguaccacagcgccaagggcagcggcguugucaucauccccguggagcugauccacgcccaccgcuacgagcaugacagcucauucgccgaggaguacgcucuccgggugcuggcggacaucgucagccugaagaaaggggacguacuccaguccguggaguucccgcugggcagccgcauccugaaggucaacacccuccuggacaucgauggguuccgggccaacaucaccgggaaggacuccgggggcaaguaccugggcaucagcuccgccagcagccucaucaucucccagguggacacgaccuacaucaagcgcgugaucagcaucaacgagcggaucuccgccugcgagaagaacaagcagagcuacaccauccgccccgaguucgacgucaucaccuccgagcggaacaucgagaucuacaauaugcugugcgagaagaucagcucccgccccuucugcaucaaguucgcgaacacgagcgacaccuucguguccggucgcgagaaguucaucgcccugagccucaacgagcaggucaagacccugaccaacaugcuguccguguucaagacgggccgggccagcgggugcgaucucaccaacaucggcggcuccaagaacaccgccaucgugaagcugaacgccgugcugagcaaccucaaggacuucaaguccguccgcaucaucgaccagagccccaccggccuguacgaaaaggugucgccgaaccugcucagccuguga

SEQ ID NO: 7797 - RNA, 4119 nt, Artificial Sequence; identical to SEQ ID NO: 1997
  Cas9 variant

SEQ ID NO: 7798 - RNA, 4119 nt, Artificial Sequence; identical to SEQ ID NO: 1998
  Cas9 variant

SEQ ID NO: 7799 - RNA, 4119 nt, Artificial Sequence
  Cas9 variant
augaacagcgacaagcgcgaggacuacuacgugggccuggacauggggaccggcucccucgggggcgccgucacggacacgcaguaucaccuccugaaggugaaggggaaggacuucugguucgugcgagaguacgagaccgccaagagccagcuggaucgccggacacaccgcaucgcgaagcggcgccugcagcggcacaaggcccgaaucggccuaauccgguccuacuucgccgaggacauccucaagcacgacccccuguucuacauccgccaggacaacagcaaguacuaccacgaggacaaggacguccggcugaccacgaaggacuccaucuucgccgacccgggcuacggggacaaggaguaccuugacgacaaggaguaccccaccaucuuccaccuccgccaggcccugcugcgggaccagaucaaggacgaggagcgcuacagccguuuccuguaccuggcgauuaucaacauguucgagcaccgcggccacuuccuccugaacaccgaguccagcgaucugaacgccgacaugaucaaggacgugggggagcucgugaugaacgccauuugcggcgucuccgaguacgggagcgugaccuacaaggagaucaucgagauccuggaggacaagaacaucucccggacggccaagaaggaccagaucgcaagcaagaucgacaucaaaaagagcgagaaggcccagauggagcgcaucaagugccugugcggcauggaggccgacgcccgggugauguucgagaucgaggccgacgagaagaucaagaucgcguuccagcaggccgccuucgaggacgagaaggaggagaucgaggccgucaucggcgaggaccgcuaccucaucaucgagaacaugaagcagcuguacgacuacagccaacugcaguccgugcucaacggguucgacuaccugagugacgcccgggugcagauguacgagaagcacaaggaagaccugcaccuccugaagaaggucuacaggaagaaccuggaccgcgagaucuacgaccggauguuccgcuccggcgaggaggggucguacugcgcguacuccaacagcaccaacagcguggacucccucgccgaggccaagaaguaccggcgcaacaugaagaagcggucgcagaaggaccuguacgaccgaaucaagaaggaccugaaggagguccacgacgccgacgccgacgcgauccggaaggagauggagcucgagcgcuuccugcccaagcagaucaccggcgccaacggcaucauccccaaccagguccauagaaaggagcugaagaagauccucgagaacgccgaacaccaccuggacuuccugaaggagaaagacgaguccggguacaccguguccgagcgcauccucaugcuguucuccagcaacauccccuacuacgugggccccgucggguccggcagcaaaacggggugggccaagauccaggaguccggccaggugcugcccuggaacauggagcagaagaucgacaucgagcagaccagugagcgguucaucaccaaccucauccgcgagugcaccuaccuguccggcgagaaggugcugcccaagcagagucuccuguacgaguccuacugcguccugaacgagaucaacaaccuccggauccacgggaagcgcaucgugccagagcugaagcaagacaucuacaaggagguguuccagggcuuccggcuggggaagaaggucacgaagaagaacaucugcaccuaccugaucaaccgcggccucaucaccgaggagagcgagguguccgggaucgacaaggagaucaacgccuaccugcccaguuacggcaagauguacggcgucuucggggagcggcugcgcgaggaggcggugcaggagaucgccgagaagaucaucuacuacggcaccaucuacggagacgccaaguccauguuccggaagaagcucaaccaguacgugagcgacggcuggaugacggaguaccaggccaagcgcaucuccggguacaaguucaaggacugggcgcgcuugucccggagcaugcugugccucuccggcugcgacaagagcaccggcgagaagaucucccugauccgcgccaugugggaguacaaccugaacuucauggagcucauuuaccgggaggacuucaccuuccagaaggagcuggaggagcgccggaaggcccuggggaagacccuccaggaguuccaguucgaggaccuggacgaguacuacuacagcgcccccgucaagcgcaugaucuggcaggccgugcaggcgcugaaggagaucacgcagaucaugggccacaaccccaagcggaucuucaucgagaugacccgcaccgaggaggagaagggggagcagggccggaagaacucccgcgagaagcgucuccugaagauguacgagagcauccgcgacgagcggaauugggccgccgagaucaagaacgcuaaugccuccggcaagcugaacagcaagaagcucuaccuguacuaccugcagauggggcgcgacguguacaccggcgagccgaucgacaucgaagaccucuucgacgacucacgguacgacaucgaccacaucuacccacgcagccugacgaacgacaacaacaucgagaacaaccugguccucguguccaagaccaucaaccagaacgaaaagaagaacgacuaccccgugcccgagaaaauucggcgcaacaagaagguccggaaccuguggcacacccugcacaagaugggguucaugaacgacgagaaguacaaccgccucaccucgacggagcggcuguccgaggaccagcuggcgggcuuuaucgcccgccagcucguggagaccgcccagggggccaagggcaucgccgagcugaugaaggcgaugcugccgggaaccgacaucgucuacgccaaggcccgcaacgucagcgacuuccggaaggaguacaagaugcugaagucccgccuuguuaacgacuaccaccacgcccaggacgcguaccugaacaucguagucgggaacguguacuuuaugaaguucacccggaaccccaugaacuuugugaagacggaggcccgccgggacggccgcaacuacgacuacaaccucuacaagauguacagcaaggacaucauccggaacggggagaaggccuggauugccaccuccgagcagggccccgggaccauccggcuggucaaagagaccaugggccggaacacccccaucaucacgcgccaggccuucgagcagcggggcgagcuguucaaccuccagccgguggggaaguacagcgcgaagaaggacaacuacgugccccugaagaucaacgacgagaagaugcaggacgucagcaaguauggcggguacaccucucugaaccccagcuacuucaucuucaucgagcacggccccgaaaagaagcgcaagaagugcuucgaggucauccacuccuacuacgccgcccagaucaagaccgagaaggaccucauugacuuccugcugcagaagggguacaagaacccgcgggugaucaacgcccgcaucaagaagaacgcccucaucaaauacaacggcuacuuccuguacaucaucggcauggaugcgcggaagaacaucgaguucagcaacgccaccgccaugugccugaagaacaaguacauacaauacgucuguaagcucgagaagaugaacaaggccauccugcugucugagaagcagaagacgaaccuccauugggaugagaaaaucacuugcgagagcaaccuggagcuguaccgcgagcucaccgagaagcacuuacacuccaucuaccaacggcacccccgcagcaucgggaagugccuggccgacggcgagggggcguucaagcugcuggacaucgaggagcaggucaagaucaucugcgacaucgugcaguacaccuccuuccagcggggcguguucagucugaaggugcuugggggccccaaggagguggggcgcauccgcaucuccgggaacaugaccgaggccaaggagugcaagcuggucaacuacagcaucaccggcauguacaagaccgagauggaccugcucaagaaguga

SEQ ID NO: 7800 - RNA, 4122 nt, Artificial Sequence; identical to SEQ ID NO: 2000
  Cas9 variant

SEQ ID NO: 7801 - RNA, 4122 nt, Artificial Sequence
  Cas9 variant
auggagaagacauacagcaucggccuggacaucgggaccaacuccgugggcuggagcgucaucacggacgacuacaaggugcccgccaagaagaugaaagugcucgggaacaccgacaagaaguacaucaagaagaaccugcugggcgcccuccuguucgacuccggggagaccgcggaggucacccgccugaaacggacggcucgccggcgcuacacgcggcgcaagaaccggcuccgcuaccugcaggagaucuucgccaaggagauggccaagguggacgagagcuucuuccagcggcuggaggaguccuuccucaccgacgacgauaagacuuuugacagccacccgaucuucggcaacaaggccgaggaggacgcguaccaccaggaguuccccacgaucuaccaccuccgcaagcaccuggccgacuccagcgagaaggccgaccuccggcugguguaccuggcccuagcgcacaugauuaaguuccgcggccacuuccugaucgagggggagcugaacgccgagaauaccgacauccagaaacuguucaacgacuucgucgagaccuacgacaagaucgccgacgagucccaccugagcgagguggacgccuccagcauccugaccaacaagaucuccaagagucggcgccuggagaaccuaaucaagcaguaccccacagagaagaagaacaccuuauucggcaaccucguggcccugguccuugggcuccagcccaacuuuaagaccaacuuuaaacuguccgaggacgcuaagcugcaguucagcaaggacaccuacgacgaggaccucgaggagcugcugggcaagaucggggacgacuacgccgaccuauucacggccgccaagaaccuguacgacgccauccugcucuccggcauccugacgguggaugacaacagcaccaaggcgccgcuguccgccagcaugaucaaacgguacgaggagcaccacgaggaccucgagaagcugaagaaguucaucaaggugaacaacuucgauaaguaccacgagaucuucaaggacaagagcaagaacggcuacgccggguacaucgagaacggcguuaagcaggacaucuucuacaagcacuuaaaauccaucaucagcgagaagaacgggggccaguacuuccucgacaagaucgagagagaggacuuccugcguaagcaacgcaccuucgacaacggcuccaucccccaccagauccaccuccaggagaugcgggccauccugcgccggcagggggaauacuacccuuuccugaaagagaaccagagcaagaucgagaagauccugacguuccgcauccccuacuacgugggcccgcucgcccgcaagaacucccgguucgcgugggccaaguaccacagcgacgagcccaucacccccuggaacuucgacgagguggucgacaaggagaaguccgccgagaaguucaucacccgcaugacccugaacgaccuguaccugcccgaggagaaggugcucccuaagcacagccacguguacgagacguacgccgucuacaacgagcugaccaagaucaaguaugugaacgagcaggggaaggaguccuucuucgacagcaacaugaagcaggagaucuucgaccacguguucaaggagaaccggaaggucaccaaggagaagcugcucaacuaccugaacaaggaguuccccgaguaccgcaucaaggaccugaucggccucgacaaggagaacaaguccuucaacgccagccuggggaccuaccacgaucugaagaagauccuggacaaguccuuccuggacgacaaggugaacgaggaggugaucgaggacaucaucaagacgcugacccucuucgaggacaaggacaugauccacgagcggcugcagaaguacagcgacaucuucaccgcaaaccagcugaagaagcucgagcgccggcacuacaccggcuggggccgccuguccuacaagcugaucaacgggauccggaacaaggagaauaacaagacaauccucgacuaccugaucgacgacggcagcgccaaucgcaacuucaugcagcugaucaacgacgacacccuccccuucaagcagaucauccagaagucccaggucgugggggacguagacgacaucgaggccguggugcacgaccugcccggcagcccggcuaucaagaaggggauacugcaguccgucaagaucguggacgagcucgugaaggucaugggcggcaaccccgacaacaucgugaucgagauggcgcgggagaaccagaccacaaaccgcgggcggagccagagccagcagcgccugaagaagcugcaguccagccucaaggagcugggcuccaacaucauaaacgaggagaagcccagcuacaucgaggacaagguggagaacucccaccuccagaacgaccagcuguuccuguacuacauccagaacgggaaagacauguauacgggcgacgagcuggacaucgaccauuuaagcgacuacgacaucgaccacaucaucccccaggccuucaucaaggacgacaguaucgacaaccgaguccugaccagcuccgccaagaaccgcggcaagagcgacgacgugccguccuuagacaucgugcgggcccgcaaggccgaguggguccggcucuacaagagcggucugaucuccaagcgcaaauucgacaaccugaccaaggcggagcgcggcgggcucaccgaggccgacaaggccggcuucaucaagcggcagcugguggagacccgccagaucacgaagcacguggcccagauccuagacgcccgguuuaacaccgagcacgacgagaacgacaagguuauccgcgacgugaaggugaucacccucaagagcaaccuggucucccaguucaggaaggacuucgaguucuacaaggugcgcgagaucaacgacuaucaccacgcgcacgacgccuaucugaacgccguagucgggaccgcacuccugaagaaguaccccaagcuggcccccgaguucguguacggcgaguacaagaaguaugacgugcggaagcucaucgccaagagcuccgacgaccacagcgagaugggcaaggcgacggccaaguacuucuucuacagcaaccugaugaacuucuucaagaccaagguaaaguacgccgacggguccguguacgagcgccccaucaucgagaccaacgcggacggcgagguggucuggaacaagcagaaggacuucgagaucauccggaaggugcugagcuacccccaggugaacaucgucaagaagguggaggagcagaccguggggcagaacggcggccucuucgacaacaacauccuggccaaaccggaaaaggacgacaagaagaagcuguucccaaucaagaagucccucagcacgacauccuacgggggcuacgcccgcgccaccaucgccuacucaauccugaucgucuccgaguucgggaagaacaaggagcugaaacuccugggccugccccuccuggacaaggugaaguacgagaagaacccgaucgcguaccugaacagcaucgggaucauuaacgucaaguccaucuucaagcuccccaaguacugccuguucgaguuccaggagaagaacaccaacuaccggcgcuacauggucagcaaccaggagcugaagcgggccaaccagcuguuccugacgugcaaggagaccgagcugguguacaaguacaucaaguccgacaacgauaacacccaccucgugggcaaugagaagaccauccugagcaucuggaacaagcuggucaucuucauggagcgcacgaagcucauagacaagaagcuguucgccucccugaagcagcucaaggacgaggugaaccugaucaacauccuggacaucgccagcaaguccaucgacuucaccaagaucagcgccgggcagaagaagaucgugcucaacgacucccugagccuacccaucaagcgguggcaguucaagagugacgagaagaugcucaagcagcugaacgacgcuacccugauccaccagagcaucaccggccucuacgagacgcgcaucgaccugagcaagcugggcgaggaguga

SEQ ID NO: 7802 - RNA, 4122 nt, Artificial Sequence
  Cas9 variant
augaacuugagacgcgcaagagacuacagcauaggacuugaccucggcacaggcagcguagguugggccgugacagacgccgagggcaaccucuauagcuucaagggucgacccgccaugggcagccgcacauucccaaacgcagagccggcaagcgucgcucggaucccgcgaggacaaaggcgccguuacgaaaggcgccgccaaagaauaaaacuucuccagcaguucuuuauguccgacauggagcgaguagaccccgacuuuuucacccgccuaaaccaaucaacacuccucgcagaagacaaagacgaacggauagcaagcugcgccuggcccaucuucaacaguagcgauuucacagaaaaggacuacuacaaaaaguuccccaccauuuaccaccuccgcgccuuccucugcgaauccgacgaaaaaggcgaccuaaggcuaguauaccuagcauuacacaacauaguaaaacaucgaggcaacuucuuauaccaagauaacccagcacugagcgcaagcgaugcuucugucgacgaggcgguccgccagcucgucgacgcccucgccgaauggugccagaacaaagaaauagagcugagcugugacgccggucggauaaucgaaguauucggcgacgccuccuuacggaggaccgacaagagagaucaacuaaagggccuccuagggcuuccagcagaccucgccaaaacuauggggaaagaacuagccuccgccguacucggcuacgcagccaacuucucuaaaauauuccuaauaagcgacgccgaacacaaauucucacugggcaacgacgagaaaguagaagaguucgaaaccauauguccuaacgaaugcaccagccucuucagcgcacuaagaacagccuacucggccuaucuacuauccggcauccuccgcgacgcgaauggcaaaacacucuccuucugcaaaaagaaagaauaugacagauaucacgaugaccuggcgcugcucaaagcccuaguucgcgaauacgcccccgagaguuaccagagcuuuuucgguggcgaacgccucgugguaaacggucguaugacaaagcgauacgacccgaccaaggccaaaggauacaccaaguacgaccuaguacacucagccggaucuuacgacgaacucgccaaagacgugaagaagcuccucggcagucucgccgccgacgacagcagguaccaaaggaugaugcaagcauucgacgaagaacgauuccuucgccgccucaaaacaagcgacaauggauccauucccuaccagcuacaccucgaagaauuaagagcaauaauagcccgccaaggugaguucuacccauuccucaaagaagaauccaagaaaauagaaucacuugucagcuuccggauacccuacuacguaggcccccuaacgaccaaaaaugccgcagucgacguucacgggaacaaacgauuugccuggagcgaacgcaaaccaggaauggagucugcgaaaguccgacccuggaauugggacgacguaaucgacaggggaaagucggcagaaaauuucaucgucagaaugaccggaaccugcaccuaccuacaaaacgagaaaguucugcccaaaugcucgcucuuguacgaggaguucugcguccugaaugaacugaacggagcgcacuggagcgcagacggagaccacgaguguccauucgauacaucugaccgacgugguauaguacaagaccucuucugcggcaaacggcgcgucagcuacaagcaaguagaggacugguugagacaacacggcucccgccgcgcgagaguaucuggaggccaaggggcgagcggcuucgaaucuaagauguccaguuacauauucuucuccaaagacguacugcacguagaccgcaucgauccagcggauuucccaaugauugaggaaaucauacuauggaacacgcuguucgaggaccgggacauccuaaaagaaaggaucgaagaagccuauggagaccgacucaacgccgaacaaauuaaaaccauaugcaagaaacgcuucacaggcuggggccgccucucacgacgucugcugaccgguauuaaagcgcagacagaccagggcgaccucucuaucauggacauccuccgcgaaggcgacccaaacaaugaccacagaggcaaggcaauggucuucaugggaauccuacacuccgaggaucuuggguuccagaagaaaaucgaccaaauaaaccaggaaaaaguaucagcgggaaaaguaucucucgaggaccuccccggcucccccgcgcuccgccgcagcauaaaccaagccaugcgcguaguugacgaaaucguaagcaucgcaaaaugcccacccucgcacauuuaccucgagguuacacgggacgaagacggagcucggaaagggcgaagaaguacccgaagauacgacgccauaaaagccgcgcuugaaaaauuuaaagaggagagccccacgugguucgaccaagacgucuucggcgaauuuaggcgcagcagggcagaggaccuagacgaacgacuaucccucuacuucaugcaaggugggaagucacuguacucggccacaccccucaaacuggaacuucuucauacgaaccaauaccaggucgaccacauaaucccccaaucauacauaaaagacgacuccuucgaaaauaaggcccuggugcuagccggugaaaaccaacgcaaaagcgacgcacuccuaauagauagcucgauacgcaccgccauggcaccauauuggagagcccuccaccaagcgggccucaugggcgacaagaaauucaacucccucaugugcucaagcauuucagauaaacgagucaggggauucauugcacgccagcuugucgaaacaagccagauugucaaacuagccggaaugaugcuccaaagcaacuaucccgaagcagacgugcaacccguaaaagcgagccuaggacacgaccuacgcguacaagccggcuucauaaaaugccgagaagucaacgacuuccaccacgcacacgacgcccuaauugcaugcgagguaggccgcuacauuaaccaaugccaccccggcaucuacgacaacccaauaggcuacgccagagcagugcgcgaacucguccgaaaacaaaacgaggaaaugagaaaguacggacggcuccccggauccgcaggcuucaucguaggaggcuucaugcggacacacguagacgucgauacuggcgaagucguaugggacgccgaagaagaacuaagccguauucgggcauaccuggacuacuccaacguauucgucacaagaaugagcgaagagaccuccggggcgcuauggaacgcaaccauauacuccccacacuacggaaaaacugcgccaacguuacauauaaaacaaggccuggaugugcaacguuacggcggauacucaagcgcaacuuucgcguacuucacccucuacguagcagagaagggcaaaaagcgaaaggcagaacuacugggcaucccaauaagcguugcaaggaaaaucgaaggcgagccauccaaacuggacgccuucguagcgcaagaugcagaagccaagaaacuaaaacacccacuuauaauccgagcccgaauacucaaauaugcacgauuugagauggaagggaaucaauucuacuucgcggcgcaggacgccguguauucagcccgccaauugguacucaagggagaccuguacucagucgccgcaaaagccugcgacaaacaucugaacgacaguugcauuagcaacgaagacuuaauacgccuauaugacgaacucguccacaaaggugaucucuuauguaacaaauucggcaauguaacagacguccuaagagccgggcgcgaacguuacgcggggcuaagcauaucagaaaaacgacagcuaguuugcaauguccuggccuacuauagaucagccaccgcucgcguagacaucagucugguaggaggcccaaagcacgcaggcaaccuaggaauagcguucguguuaaacaacccggaagccaucguauuugucgaccaauccguaaccggaauguuugaaaaacgcaccaggguagaacuauga

SEQ ID NO: 7803 - RNA, 4122 nt, Artificial Sequence; identical to SEQ ID NO: 2003
  Cas9 variant

SEQ ID NO: 7804 - RNA, 4122 nt, Artificial Sequence
  Cas9 variant
augaccaagaagaacuacagcaucggucuggacauugggaccaacuccgugggcugggccgucaucacggacgacuacaaggugcccgccaagaagaugaaggugcucgggaacaccgacaagaaguacaucaagaagaaccugcugggcgcgcuccuguucgacagcggggagaccgcggaggccacccgccugaagcggacggcccgccggcgcuacaccaggcgcaagaaccggcuccgcuaccugcaggagaucuucgccgaggagaugaccaaggucgacgaguccuucuuccagcggcuggacgagagcuuccuacgcugggacgacgacaacaagaagcugggcagauacccgaucuucggcaacaaggcggacguggugaaguaccaccaggaguuccccaccaucuaccaccuccgcaagcaccucgcggacuccagcgagaaggccgaccuacggcuggucuaccucgcccuggcgcacaugaucaaguuccgcgggcacuuccugaucgagggcgagcugaacgccgagaacacggacgugcagaagaucuucgccgacuuugugggggucuacgaccggaccuucgacgacucccaccugagcgagaucaccguugacgccgccuccauccugaccgagaagaucagcaagucccgccggcucgagaaccugaucaaguauuaccccacggagaagaagaacacccuguucggcaaccucaucgcgcuggcccucgggcuccagcccaacuucaagaugaacuucaagcugagcgaggacgccaagcugcaguucuccaaggacagcuacgaggaggaccucggcgagcugcugggcaagaucggggacgacuacgccgaccucuucaccuccgccaagaaccuguacgacgcgauccugcucagcggcauccugauuguggacgacaacuccaccaaggccccgcuuagcgccuccaugaucaagcgcuacgucgagcaccaggaggaccucgagaagcugaaggaguucaucaaggccaacaagagugaacuguaccacgacaucuucaaggacaaaaacaagaacggguacgccggcuacaucgagaacggcgugaagcaggacgaguucuacaaguaccucaagaacacgcugagcaagaucgcgggguccgacuacuuccuggauaagaucgagcgggaggacuuccuccgcaagcagcggaccuucgacaacggcagcaucccccaccagauccaccuccaggagaugcacgccauccugcgccgccagggggauuacuaccccuuccugaaggagaaccaggaccggauugagaagaucuugaccuuccgcauccccuacuaugugggcccgcuggcccggaaggacucccgcuucagcugggccgaguaccacuccgacgagaagaucacccccuggaauuucgacaaggucaucgacaaggagaaauccgccgagaaguucaucacgcggaugacccugaacgaccucuaccugcccgaggagaagguguuacccaagcacagccacguguacgagaccuacgcggucuacaacgagcucacgaagaucaaguacgugaacgagcaggggaaggacagcuucuucgacuccaacaugaagcaagagaucuucgaccacguguucaaagagaaccgcaaggucacgaaggagaagcugcugaacuaccucaacaaggaguucccggaguaccggaucaaggaccugaucggccuggacaaggagaacaagagcuucaacgccucccucggcaccuaucacgaucugaagaagauccuggacaaggccuuccucgacgacaaggugaacgaggaggugaucgaggauaucaucaaaacccugacccuguucgaggacaaggacaugauccacgagcgccuccagaaguacucugacauuuucacggccgaccagcuaaagaagcuggagcggcgccacuacaccggguggggccggcucuccuacaagcugaucaacgggauccgcaacaaggagaacaacaagaccauccuggacuaccucauagacgacggcagcgcgaaccggaacuucaugcagcugaucaacgacgacacccugcccuucaagcagaucauccagaagucccaggucgugggggacgucgacgacaucgaagccguggugcacgaccuccccggaagccccgccaucaagaagggcauccugcaguccgucaagaucguggacgagcuggugaaagucaugggggacaacccggacaacaucgugaucgagauggcccgcgagaaccagacgaccaaccggggccgcagccagucccagcaacggcucaagaagcugcagaacagccugaaggagcucgggagcaacauacugaacgaggagaagcccuccuacaucgaggacaagguggagaacagccaccuccagaacgaccagcuguuccuguacuacauccagaacggcaaggacauguacaccggggaugagcuggacaucgaccaccuguccgacuacgacaucgaccauaucaucccccaggccuucaucaaggacgacagcaucgacaaccgcgugcugaccuccagcgcgaagaaccggggcaaguccgacgacgugcccagccuagacaucgugcgcgcccgcaaggccgaguggguccggcucuacaaguccggccugaucagcaagcgcaaguucgacaaccugacgaaggccgagcgcgguggccucaccgaggccgacaaagcgggguuuaucaagcggcagcugguggagacccggcagaucaccaagcacguugcccagauccuggacgcccgcuucaacaccgaguccgacgagaacgacaaggucauccgggacgugaaggugaucacgcucaagagcaaccuggucucccaguuccgcaaggacuucgaguucuacaaggugcgggagaucaacgacuaccaccacgcccacgacgccuaccugaacgcuguggucggcaccgcgcucuugaagaaguacccgaagcuggccagcgaguucguguacggcgaguacaagaaguaugacauccgcaaguucaucaccaacuccagcgacaaggccaccgcgaaguacuucuucuacucuaaccucaugaacuucuucaagcgggugauccgcuacagcaacgggaaggucaucgugcgucccgugguagaauacagcaaggacaccgaggacaucgccugggacaagaaguccaacuuccgcaccaucugcaaggugcugagcuacccccaggugaacaucgugaagaagguggagacccagaccggcggguucuccaaggagagcauccuccccaagggcgacuccgacaagcucaucccgcggaagacgaagaaggccuacugggacaccaagaaguacgggggcuucgacagccccaccguggccuacucugucuucgugguggccgacgucgagaagggcaaagcgaagaagcugaagaccgugaaggagcugguggggaucagcaucauggagcgcuccuucuucgaggagaaccccguagaguuccucgaaaacaagggcuaccacaacauccgggaggacaagcugaucaagcugcccaaauacagccucuucgaguucgagggcgggaaacgccggcugcuggccuccgccagcgagcuccagaaggggaacgaaauggugaucccgggccaccuggugaaacuucucuaccacgcccagcgcaucaacuccuucaacuccacgaaguaccucgacuacgucuccgcccacaagaaggaguucgagaaggugcugagcugcguggaggacuucgcgaacuuauacgucgacguggagaagaauuuguccaagauccgggccguggccgacagcauggacaacuucuccaucgaagagaucuccaacucuuucauuaaccugcucacccugaccgccuuaggcgcccccgcggacuucaacuuccucggggaaaagaucccccgcaagcgcuacaccuccacgaaggagugccugaacgccacccugauacaccaaagcaucaccggccucuacgagacccggaucgaccuguccaagaucggggaggaguga

SEQ ID NO: 7805 - RNA, 4122 nt, Artificial Sequence
  Cas9 variant
auggagaacaagaacuacagcaucggccuggacaucgggaccaacuccgugggcugggccgucaucaccgacgacuacaaggugcccagcaagaagaugaaggugcucgggaacacggacaagcgcuucaucaagaagaaucugaucggcgcccugcuguucgacgaggggaccaccgcggaggcccggcgccugaagcggaccgcccgccggcgcuacacgcggcgcaagaaccggcugcgcuaccuccaggagaucuucgccgaggagaugagcaagguagacagcuccuucuuccaccggcuggacgacagcuuccugaucccggaggacaagaagggcuccaaguaccccaucuucgccacccucaucgaggagaaggaguaccacaagcaguuccccacaaucuaccaccuccgcaagcagcuggcggacagcaaggaaaagaccgaccuccggcugaucuaucuggcccucgcccacaugauaaaguaccgcggccacuuccuguacgaggacacguucgacaucaagaacaacgacauucagaagaucuucaacgaguucaucucgaucuacaacaacaccuucgaggggaacagccuguccggccagaacguccagguggaggccaucuucaccgacaagaucagcaaguccgcgaagcgggagcgcguucucaagcuguucccagacgagaaguccacagggcuguucagcgaguuccucaagcugaucgugggcaaccaggccgacuucaagaagcacuucgacuuagaggagaaggccccgcuccaguucagccgggacacguacgacgaggaccuggagaaccugcucggucaaaucggcgacgacuucgcagaccuguuuguggccgcgaagaagcuguacgaugccauccuccucuccggcaucuuaaccgucaccgaccccagcacuaaggcgccccucuccgccagcaugaucgagcgcuacgagaaccaccaaaaggaccuggcuacgcuaaagcaguucaucaagaccaaccuccccgagaaguacgacgagguguucagcgaccaguccaaggacggguacgcggguuacaucgacgggaaaacaacccaggagagcuucuacaaguacaucaagaaccugcuguccaaguucgagggcgccgacuacuuccucgagaagaucgagcgggaggacuuccugcgcaagcagcggacguucgacaacggcagcaucccgcaccagauccaccuccaggagaugaacgccauccugcgccgccagggggagcacuacccauuccugaaggagaacaaggagaagaucgagaagauccugaccuuccggauccccuacuacgugggaccccucgcgcgcgguaaccgggacuucgccuggcugacccgcaacuccgaccaggcgauccggccguggaacuucgaggagaucgucgacaaggccagcuccgccgagagcuucaucaacaagaugaccaacuacgaccuguaccuccccgaggagaagguucugcccaagcacucccugcuguacgagacguucgccguguacaacgagcucaccaaggucaaguucaucgccgagggccugcgcgacuaucaguuccuggacagccggcagaagaaggacaucuucuacacccuauucaaggcggaggacaagcgcaaggugaccgagaaggacaucauccaguaccugcacacgguggacggguacgacggcaucgagcugaagggcaucgagaagcaguucaacgccucccucagcaccuaccacgaccugcugaagaucauuaaggacaaggaguucauggacgaccccaacaacgaggagauccuugagaacaucguacacacccugaccaucuucgaggaucgggagaugaucaagcagcgccuggcccaguacgacucccucuucgacgagaaggugaucaaggcccugacgcggcgccacuacaccggguggggcaaacugagcuccaagcucaucaacgggauccgggacaagcagaccggcaagaccauccuggacuaccugauggacgacggguacaacaaccgcaacuucaugcagcucaucaacgacgacgagcugagcuucaaggagaucaucaagaaggcccagguggucggcaagacggacgacgugaagcaggucgugcaggaguuaccugguucccccgccaucaagaaggggauccuccagagcaucaagcugguggacgagcuggucaaggugaugggccacgagcccgaguccaucgucaucgagauggcccgggagaaccagaccaccgcccgcgggaagaagaacagccagcagcgguacaagcgcaucgaggacagccucaagaucuuggccuccggccugaacgcgaagauccucaaggagcaucccaccgacaacauccagcugcaaaacgaccggcuguuccucuacuaccugcagaacgggcgcgacauguacaccggcaagccgcuggacauaaaccagcucucguccuacgacaucgaccacaucgucccccaggccuucaucaaggacgacagccuggacaaucgcgugcugacgucccucaaggacaaccggggcaagagcgacaacgugcccucccuggaggucguggagaagaugaagaccuucuggcagcagcugcuugacagcaagcugaucuccuaccgcaaguucaacaaccugaccaaggccgagcgcggcgggcucgacgagcgggacaaggugggguucaucaagcggcagcuggucgagacccgccagauaacgaagcacguggcccagauccuggacgcgagauacaacaccgaggugaacgaaaaggacaagaagaaccgcaccgucaagaucaucacccucaagagcaaccugguguccaacuuccggaaggaguuccgccuguacaaaauccgggagaucaacgacuaccaccacgcgcaugacgccuaccucaacgccguagucgccaaggccauccugaagaaguacccuaagcuggaaccggaguucguguacggggacuaccagaaguacgaccucaagcgcuacaucagccgguccaaggaccccaaggagaucgagaaggcgacggagaaguacuucuucuacagcaaccugcugaacuucuucaaggaggaggugcacuacgccgacggcaccaucgucaagcgcgagaacaucgaguacuccaaggacaccggggagaucgccuggaacaaggagaaggacuucgccacaaucaagaaggugcucagcuuaccccaggugaacaucgucaagaagcgggaagugcagacgggcggguucucuaaggagagcauccugcccaagggaaacagcgacaagcucaucccgagaaagaccaaggauauacugugggacacuaccaaguacgggggcuucgacucccccgugaucgcguacagcauccugcucauagccgacaucgagaagggcaaggccaagcggcugaagacggucaagacccugguggggaucaccaucauggagaaggccaccuucgagaaguccccaaucgccuuccucgagaacaagggcuaccacaacgugcgcaaggagaacauccugugccugccgaaguacagccucuucgagcugaagaacgggcggcgccggaugcuggcguccgccaaggaacuccagaagggcaacgagaucguccugcccgugcaccugacgaccuuguuauaccacgccaagaacauccaccgccuggacgagcccgagcaccucgaguacauacagaagcaccgcaacgaguucaaggggcugcugaaccucgugagcgaguucucccagaaguacguccuggccgacgccaaccuggagaagaucaagaaccucuacgcggacaacgagcaggccgacaucgagauccuggccaacagcuucaucaaccugcucaccuucacugcccugggcgcccccgcagccuuuaaguucuucggcaaggacguggaccggaaacgcuacacaaccguguccgagauccugaacgccaccuuaauucaccagagcaucaccgggcuguacgagacgcggaucgaccuguccaagcucggcgaggacuga

SEQ ID NO: 7806 - RNA, 4125 nt, Artificial Sequence
  Cas9 variant
auggagaccaaguucaccuacuacuugggccucgauauggggacggacagccugggcugggccgugaccgacuccagcuaucacauccugcgcgccaaggggaaggaccucuggggcguccggcuguuccccuccgcggagaccagcguggagcgccgaaccuaccgcgugaaccggcgccggcgccagcgggaggucgcccgcaucggggcccucaaggagcuguuugccgacgagauugagaagguggauccgggcuucuucgugcgccuggacgaguccaaguuccacauggaagaccgauccgagaacaacaagcagaaguacggccuguuugccgacaagcuguucuccgacgccggguacuacaagaaguaucccacgaucuuccaccuccggaaggaacuccucgaaagcgaggaaccccacgacguccgccugguguaccuggcccuccugaacauguucaagcaccggggccacuuccugaacuccagccuccagaucgagggggagaacuccaacaucgccgaguccuaucagauguucguggacacccugaccgacgaggaccuggacuucccagagcaggucuccggagaacgccuccaggagauuuuccggagcucggacagccgcaagaagaagguggaaaaccuacuggccgaaaugaaccucuccaagaagcagaagcgggagauccaguucgugaaccugaucugugggcugaagggcaagcucagcgagcuguucccggacaaggaguacgacgaggagcagaagaagaucgcguucuccuuucaggacagcgacuaugaggacaaggagaacacaauccaggagcuucucgacgagagcgagaugaauaugaucuacgccgucaaggcagugcacgacuccggcgugcugagcgggaucaugaacggcgagcgauaccuguccguugcucguguggccagcuacgaaaaacacaagaaggaccuccaaauccugaaggauauccugaagaaguaugacacgaaggaguacuucgagauguuccgcaacgaguccgccaagucagaguccuacagcgcguacguggguuccgucaaguaccacggcaccuuccgccggggccucucugggggcaagcaggaggaccuguacaagcauaucaaaaagguccuugggaaguucccgcaggacgacgagggcguaaccuauaucuuggaggagaucgagaccgaguccuuccugcccaaacagcugacggccagcaacggggucauacccaaccaggugcacgcccgcgagaugcuggccauccugaaacacgcugagcuguaucucccauuccugcaagagaaggacgacaccggacuguccgugagcgagaagauccucaagcuguucauguuccagauccccuacuacgucgggccccucgggcaggaguacaaggacaagaagggcuauaacgugugggccgagcggaaagccuccgggaagaucuaccccuggaacuucgaggacaagaucgaugucaagaaguccgccgagaaguucaucggccgcauggugcggcgcugcaccuaccugagcggggagcaggccuuaccgaagcagagccugcuguacgagaaguuccaggugcucaacgagcugaacaaccugcggauccgcggcgagaagaucccggucucccuuaagcaggagaucuaccacgauuuguucggcgacggcaagaaggugagcaugacccgccuuacaaacuacuuacugcagaacggcgugauaagcggggaggagaaagacuccugcaucagcggcaucgacgggggcuuccacaacucccugagcagcgucggcaaguucaaggggguguucggcgacaccgugcacaccgacgagcaccgcaagaugaucgaggacaucaucuucugggggaccgucuucggcgacggcaagaagcuccugaaggagaagguggaggagguguacgggaaccagcugacggaggcgcagaagaagcggaucuucggcuucaaguucucauccugggggcgccucagcaaggccuuccugaccauggagggcgcguccaaggacgacggggagaucaagggccugauucaagccaugugggacaccaacugcaaccucauggagcugcugagcgaccgguucaccuacaaggacaagcucaaugagauggucacgaccgccgagaaaccccugugcgaguggaagaucgaggaccuggacgagauguacuuauccgcccccgugaagcgcaugguguggcagaccauccgggucguggaugaagugcagcagaucaucggcugcccgcccaagcggaucuucgucgagaugacacggagcgacggggagaagggcaaacgcacggugucccggcagaaaaagcugguggaccuguacaaagcccucgggaaggagggcaagaccuggagcgaggagcuguccgacacccccgagagccaguuucggaucaagaagcuguaucuauacuaucugcagauggggaagugcauguacaccggcgaggccaucgagcuggagcagcucaugaacgacaaccuguacgacaucgaccacaucuacccccgccacuucauaaaggacgacaacaucuccaacaaccugguccucgugaagaaggagaagaacgcccacaagagcgacagcuuuccgaucgagcccgaaauccggaacaagaugaugcccuucuggaagucccugcgcaagaagggcuuucugacugaggagaaguacaaccgguugacccgcaugucagcguuuaccgacgaagagaaagccgcguucaucgggcggcagcugguggagaccucccagggcacgaaggccaucacccagaucuucgagcaggccuucgcgaacagcgagaucgucuucuccaaagccagcguuguguccgccuuccgucagaaguuugauugcuacaagguccggugcguuaacaacuaccaccacgcccaugacgccuaccugaacauuguggcggggaacaccuaccgcgucaaauucaccagcaacccccucaacuucaucaaggaggcuaagaagaacccgaacucccgggagaacagauacaauauggacaagaucuuugagugggacguuacucggaacggcgagacugcguggguggcccagacaaaggagcaccccgggaccauccagcuggucaagaaguaccugaacaagaacagcccccucaucaccaagaugguguacgagaagcacggcggcaucacgcagaaagccaccaucugguccgcaaagaaggcggagagugggaacaccgacgccuacauccccgugaaaaugaacgacccgcgccuggccgacgucaccaaguacggcgggguaacgacuauagcgguggccggcuacacccugcucgaguacaaggcuggagggaagaccguacgguccuuagaggcccugcccaucuaccucggcgggagcaagaagcugacggaggagcagaugguggaauacuucuccaacgugcuucagcaggaaaacaaggagaaggucgugagcgacgugaucauccgcaagaagaugaucccuucuggcagccucaucaaguacaacggguucuacuacuaccuggccggcaagacaggcgaccggaucauccugaucucggcgguucagcucugccugccgauggauaccaugcuguacaucaagaagaucgagaaagccugcagcaccgggaacuucgaggagaaggacaagaacggcaagcagguccucaguaagcagcagaacgaguucguguacgagcugauuauacagaaguaccagcaguccauuuucaaaaagaaggugggugccaucggcgacacgaucaucgagaagcgcgagaaguuugccgagauaagccuggaggagcagugcaaggugcucaugcagaucuuccugaacuuccaauccgggaucgguguggagcugaagaucaucgagggaggcaaaaaguccggagucaccuaccuuaacaagaaggugaugaacguccaggagcugaagcugauagaucagagcgugaccgggguguucagccgggagaucgaccuccugaccaucuga

SEQ ID NO: 7807 - RNA, 4125 nt, Artificial Sequence; identical to SEQ ID NO: 2007
  Cas9 variant

SEQ ID NO: 7808 - RNA, 4125 nt, Artificial Sequence; identical to SEQ ID NO: 2008
  Cas9 variant

SEQ ID NO: 7809 - RNA, 4128 nt, Artificial Sequence; identical to SEQ ID NO: 2009
  Cas9 variant

SEQ ID NO: 7810 - RNA, 4128 nt, Artificial Sequence
  Cas9 variant
augaaggaauaccacaucggccucgacaucgggaccaguucaaucggcugggccgugacagacucucaguucaagcucaugcgcaucaaggggaagacagccaucggcgugcgacuguucgaggaagggaaaaccgcggccgaacgccggaccuuccgcaccacgcggcgcagauuaaagcgcaggaaguggcgccuccacuaccuagacgagaucuucgccccgcaucugcaggagguggacgaaaacuuccuccggcgccugaaacaguccaauauccacccggaggaccccgccaagaaccaggcauucaucggcaagcuccucuuccccgaccugcugaagaagaacgagcggggauaccccacccucaucaagaugcgcgacgagcuaccgguggagcagcgggcccacuaccccgucaccaacaucuacaagcugcgcgaggcgaugauuaacgaggaucggcaguuugaccuccgcgagguguaccuggccgugcaccacaucgucaaguaccguggccacuuccugaacaacgccucgguggauaaguucaaggucggucgcauugauuucgacaagaguuucaauguccucaacgaggcguacgaagaacugcagaauggggagggcagcuucaccauagagccguccaagguggagaagaucgggcagcugcuauuagacacgaagaugaggaagcuggaccgccagaaggccguggccaagcuccuggaggucaagguggccgacaaagaggagaccaagcgcaacaagcagaucgcaacugcuaugucuaagcuggugcucggcuauaaggccgacuucgccaccgucgcuauggugaacggcaacgaguggaagaucgaucuguccagcgaaacguccgaggacgagaucgagaaguuucgcgaggagcugagcgacgcccagaacgacauucucaccgaaaucacaucccuguucagccagaucaugcugaacgagaucgugcccaacgggaugaguaucagcgaguccaugauggaccgcuacuggacccacgagcggcagcuagcggaggucaaggaguaccuagccacgcagccggccagcgcccgcaaagaguucgaccaaguguacaauaaguacaucggccaggcccccaaggagaagggguucgaccuagagaagggccucaagaagauucuguccaagaaagagaacuggaaagagaucgacgagcugcucaaggcgggcgacuuccugcccaagcaacgcaucagcgccaauggggugauaccacaccagaugcaccagcaggaacuggacagaaucauugagaagcaggcaaaguauuacccguggcucgccaccgagaaucccgcgaccggcgagcgggaucgccaucaggcgaaguacgagcuggaccagcuggugagcuuccggauccccuacuacgugggcccccucgugaccccugagguccagaaagccacguccggcgccaaauucgccugggcgaagcgcaaggaggacggggaaaucacccccuggaaccugugggauaagaucgaccgggccgagagcgccgaggccuucauuaagcgcaugaccgucaaggacaccuaccuguuaaaugaggacgugcugcccgcaaacucccugcuguaucagaaguacaacgugcucaacgagcugaauaacgugcgggucaacggccgccggcucuccgucggcaucaaacaggacaucuauacggaacucuucaaaaagaagaagaccgugaaggcgucggacgucgcuagccuggugauggcgaagacccgcggugugaacaagccguccguugagggccugagcgauccgaagaaguucaauuccaaccucgcuaccuaccuggaccugaagaguaucguaggggacaaaguggacgauaaccgguaccagauggaccuggagaacaucaucgaguggcgcuccgucuucgaagacggagaaaucuucgccgacaagcugacggagguggaguggcugaccgacgaacagcggagcgcguuagugaagaagagguacaagggguggggccgccucuccaagaaguugcucaccggcaucgucgacgagaacgggcagcggaucauagaccuuauguggaauaccgaucagaauuucaugcagaucgugaaccagccaguguucaaggagcagaucgaccagcugaaccagaaggccauuacgaacgacggcaugacccugcgcgagcggguagagagcgugcuagacgaugccuacaccagcccccagaacaagaaggcaaucuggcaagugguccgugugguggaagacaucgucaaagccguggggaacgcgccuaaguccauuuccauugaguuugcacggaacgaggggaacaaaggcgaaaucacccgcucgcggcgcacgcaguugcaaaagcuguucgaggaccaggcccacgaauuagugaaggacaccucucugaccgaggagcuagagaaggugccggaccugagcgaccgguacuacuuuuacuucacccaggguggcaaggacauguacaccggggaccccaucaacuucgaugagaucagcacgaaguacgacaucgaccauauucugccccaguccuucguuaaagaugacagccucgacaacagggugcugaccucacgaaaggagaacaacaaaaagagcgaccagguccccgccaagcucuacgcggccaagaugaagccguacuggaaucagcuucugaagcagggcuuaaucacgcagcgcaaguucgagaaccucaccauggacguggaccagacgaucaaguaccggucccuuggcuucgugaagcgccaacuggucgagacccgccaagugauuaagcucaccgccaauauccugggcagcauguaccaggaagccggcaccgacauaaucgagacgcgcgccggccugaccaagcaguugcgggaagaguucgaccugcccaaggugcgcgaggucaaugacuaccaccaugcgguagacgccuaucugaccaccuucgccggccaguaccucaaucggcgcuacccgaagcugcgguccuucuucguguacggggaauacaugaaguucaagcacggcagcgaucugaagcuccggaauuucaacuucuuccacgagcugauggagggggacaagucccagggcaaggucguggaccagcagaccggcgagcugaucaccacccgcgacgagguggccgacuacuucgauuggguccaggaccucaagcuaaugcuggugaccaaggaacuuaagagaagcaacgggaagcuguucgacgccacgauccagaacgcgaacuacaccaagcugaacgagcgcaaaaagguuuucgucccucugaagaaggagcuggauaagacccuguacggcuccuauucagguauccaguccagcuacaugaccaucgugaagaaauuugacaagaagggcuccacguacgccgugcagagaauccccgucauguacagcaagcuacuggagcuugagaaggagcagucgaagcucaaccgccuagugcaaagcauagugaccagcgacccucaggcacccaacaacuucgagguccugaugccgugcguucucuccgggcagcuagucaucgacaacggccguaaauuuacccugacaagcuaccgguaccaguguuccaccgcgcaacucuuccugccaaagaaggaucugaaguacauccagaacaacuucaaggagcucaagaaaacccccgacaaacaggacaagauauucgagacgaucuacgaugacauacuaaaacagguggacaaguacuucucucuguacgacaucaacaaguuccgguccaagcuccacgacggcaaggacaaguuccuggccuuagagaauuucggggagaaagagucuaaggacaaggugaucacuaagauccuccgcggucugcaugcgaacgccgagcggacauccuuaaaggagaucggccucagcacaccccugggccaguuccagucgggggagggcggcaucacccugagcgacaacaccaagaucauauaccagaguccgaccggucuguuugagaggcaugucuaccugaaagaccuguga

SEQ ID NO: 7811 - RNA, 4128 nt, Artificial Sequence; identical to SEQ ID NO: 2011
  Cas9 variant

SEQ ID NO: 7812 - RNA, 4128 nt, Artificial Sequence
  Cas9 variant
auggaaaacaagaaguacagcaucggccuggacaucgggaccagcagcaucggcuucgccguggucgacgagaacaaccgcgugaugcgggugaaggggaagaacgccaucggcguccgccucuuuuccgagggacagcccgcggccgaccggcgcagcuuccggaccacgcgccggcgccugucccggaggcgguggcgccugcggcuacugcgcgagaucuucgagccguacaucaaccccguggacgaggcuuucuucaugcggcugaaggagagcaaccucucucccaaggaugccaacaagcacuacagcggcgacauccuguuuaacaaccagaccgaccaggacuucuacgagaaguaccccaccaucuaccaccucaggcacgcucugaugaccgagcaccggaaguucgacgugcgcgagauauaccuggcgauccaccacaucguaaaguuccggggccacuuccugaacgccgccucggccagcaacuucacgguagggaagcucaaccuggagggcaaauucgacgcgcugaacgagaucuaccagcgcgugcucaccgacgacccguucgcccugaggaccgacaaccuggaccacaucaaggagauccucaucgacaacaagcgcucccaggccgaccgccagcggacccugacgggggacgucuaucagagcuccgaggagaaggagaucgagaagcgcaacaaggccaucgccacagagauccugaaggcggccguggguaacaaggccaagcucaacgugaucaccaacguggagguggacaaagaggccgccaaggacuggagcuuaaccuucgacucugagacgauagacgacgagcuggccaagguggacgggcagaugacugacgacggccgggagaucaucgagauccuccgcucgcuguacuccggcaucacccuggccgcaauuguccccgagaaccacacgcucagccaguccaugguggagaaauacaacagccacaaggcccaccugaaacugcucaaggaccugaucaacaacaugacggacacuaagaaggccaagaaccuucgggcggccuacgacggguacaucgacggcgugaagggcaagguccucacccgggacgauuucuacaagcaaauccagggcaaccuggacgacagcgcagaagcccagaagauucaggacgugauggaccaggacgaguucaugcccaagcagcggaccaaggccaacggcuccaucccgcaccagcugcagcagcaggagcucgaccagaucguggagaaccagaaggaguacuacccguggcuggcggaagaaaaccccaacgagacucguaggggcgucgccaaguacaagcuggacgagcucgugaccuuucgggugcccuacuacgucgggccuaugaucaccgccgaggaccaggagaagcagagcggggccuccuucgcauggaugaagcggaaggagccgggcaacaucacccccuggaauuuugaccagaagguagaucgaauggccucugccaaccaguucaucaagcggaugacgaccaccgacaccuaccuucugggggaggacguccuccccgcccagucccugcucuaccaacgcuucgagguguugaacgagcugaacaagauccggaucgaucgcaagcccaucagcaucgagcugaagcagcagaucuucaacgaccucuucaagaaguucaagaacgugacgaucaaacaccuucaggaguaccuggucgccaccggcggcuacgacaaacggccgcgcaucgacggguuagcggacgaaaagcgguucaacagcggccugagcgccuaccacgaccugcacgggauccugggcgccgaggugguggacgccaacgacaagcaggacgaccucgagaagaucaucgagugguccaccaucuucgaggacaagaagaucuaccgcgccaagcuggacgagcugaccuggcucacggacagccaaaaggagaaacuggcgaccaagcgcuaccagggguggggccggcuguccaagaagcuacugagcggccugcgcaacagcgaccaccggucgauccucgacauccuguggaucaccaacgagaacuuuaugcagauccaggccgacccugacuuugccgagcuggucaagaacgccaaccaggggaugcucggcaagaacaacucucaggacgugaucaacgaccuguauaccagcccccagaacaagaaggccauccgccagauccugcuuguaguccacgacauccagaacgcgaugcacgggcaggcccccgccaagauacacguggaguucgcccggggcgaagaacgaaacccgcggcgcuccauccagcgccagcaucagaucgaggcggccuacgacaaggugaccagcgaccugcuggucgacgccggggugcgccaagagcucaaggacgccaucaacgacaaacgggacuucaaggaccgccuguuccuguauuucaugcagggcggccgggacaucuacaacggcgagcccaucaacaucgaccgccucuccagcuacgacaucgaccacauccugccacaggccuucgugaaggacgacagccugaacaaccggguccucacagacgcggagggcaaccgccggaagucagacgccgugcccagcgagcuguucggggccaagaugagauccaccugggagcugaugcgggagcagggccucauaagcaaggccaaguaccgcaaccuuaccaugaaccccgagaacaucaacgcccacaccgagaacggcuucaucaaccggcagcugguggagacgcgccaggucaucaagcucgcggugaacauccuggccgacgaguacaccgaggacacccagaucguguccgucaaggccgaccugagccaccagaugcgcgaagacuucgagcuccugaagaaccgggacgugaacgacuaccaccacgccuucgacgcguaccuggcggccuucaucgggaacuaccuccuggagcgcuaccccaagcugcaguccuacuucguguacggcgacuuuaagaaguucagccagaaggacaccaagaugcggcgcuucaacuucaucuaugaccucaagcacuccgaccagaucgccgauaagaacgggaagaagaucuggcacaagacgaacgaccuggacuacauucggcaccuguucgccuacaagaagauccuuaucagccacgaggucuccgagcgcagaggagcgcuguacaaccagaccguguacaaggccagcgacgacaaggccuccgggcagggcucaaagaaguuaauccccaucaaggccaacaagcccaccgaaaucuacggcggguacaccgguaagacguuagccuacauggcgaucgugaaggucaucaaggggaagaagaucgccuauaagguggugggcgucccgaccuccgcccuggugcagcuggccgggaucgagcacggcagccaggaggaguuaaaccgccuguacgacgugcugaagccccaguucacacagcucaagaagaacaacaagaccggcgagaucuccgagacggucagcaaguucgagaucgugaucccccggguuaaauaccaacagcuggucgaggacgacgacaagcuguucaugaucgggagcgacaccuauccguauaacgcccagcagcucgugcuguccgagggcgcgcugaaggugaucaacaacgucuacaggaagggggagaacagcgacaagcaggaguccuacaagcucgacgacguguacgacgagaucaucaucgccaugaagaaguacuucccccuguacgauaaccggggcuuccgcgagaaggucgccgagggcaagagcaccuuugagaaccugcccaucuccaacgaguucaagaacggcaaacucaccaagauuggcaagaaggaggucaucaaccggaugcugcaggggcugcaugccaacgccacgaugaccgaccucaagauccugggcaucaagagccccuuuggguucaugcagcagccgaccggcaucgcguuauccgagaacgcccagcucaucuaccagagccccaccgaccuguucgagcgccgggugcagcugaauaagaucaaguga

SEQ ID NO: 7813 - RNA, 4128 nt, Artificial Sequence
  Cas9 variant
augaagaagaucuuaggccucgaccuggggaccaccagcaucggcugggccuuaguguacgaguccgaaaacacggacgagaaguccagcaucguccgccucggggugcgggugaacccccugagcgucgacgagaagggcaacuucgagaaggggaaggccaucaccaccaacgcugaccgccagcaaacccacggcgcccggaucaaccugcagcgcuacaaacuccgucgcgagaaccugaaggacugucugcagaagcagggcuggaucgggacggaggcccucugcgaggagggcaagaccuccaccuucgagaccuacaugcugcgggccaaggccgcggaggaggaaauuagccugcacgaguuaugcagggugcuguuuaugaugaacaagaagcggggguacaaguccaacaggaaggccaacaauaaggaggacggcaaacuguucgacgggaugacaguggccaagaagcucuacgaggagcaccugaccccggccgaguacagcuuccagcuccucuccagcggcaagaaauucaagcaggaguacuaccgguccgaccuuaaggaggaauuugaccgcaucuggaacgagcagcagaaguacuaccccgagaucuugaccgacgacuucaagcagcagcuccagggcaaguccaaagggaacaccuccaagaucuuccugggcaaguacgggaucuacagcgcggaccugaagggccucgaccggaagcugcaaccccugaaguggcgcgucgaggcccucaagcagcaggucgacaaggagguccuggccuucgugaucuccgaccugaacggccagaucgccagcacguccgggcugcugggcgccaucagcgaccggaguaaggagcuguacuuuaacaagcagacuguggggcaguaccucuggacuagccugaaggagaccccgcacguaucuaucaaaaacaagccguuuuaccgccaggacuaccuggacgaguucgagaagaucugggagacgcaagcgaccuaccacaaggagcuuacccccgagcugaagcaagagauccgggacaucaucaucuucuaucagcgcccccugaaguccaagaagggccucaucucugucugcgaguuagagcagcggaaggugaagguuaccaucgacgggaaggagaaggagaucuccaucggccccaagguggcccccaagagcucccccauguuccaggaguuccgcauuuggcagaaccugaacaacauccuccugaucgacaagggcaacaacagcauccacccucuguacgaggaggaaaagaaccuccuguacgaggaacuguccgugaaggagaaguuaagcaaggcugaggcccugaagguccugaacaagaauagcaaacagugggaccugaacuacaaggaaaucgaggguaaccggacccaggccguccucuacgacugcuacaaccgcauuauagugaugaccggccacgaggaauacaacuucaagaagcugaaggccagcgagauccgcuccuacgugaagaccaccuucacggggcugggcuucaacaccgacauccucgaguucgacagcucccugaccgggcacgagcuggaaaagcagcccauguaccagcucuggcaccuccuguacaguuacgaguccgacaacagccgcaccggcaacgacgcccugcugcgcaagcuggagacggccuucggcuucccgaaggaguaugccgccgugcucuccgacgugguguucgaggacucauacggaaaccuguccgucaaggcgaugcggaagauucugccccaucuccaagccggccugaacuacagccaggccugcgaggaagccggguacaagcacagccgccggucucugaccaagaacgagcucgaccagaaggaguacaaggagaaacuugagcugcuccccaagaacagccugcacaaccccgugguggagaagauccugaaccagaugaucaacgugaucaacgccgugaucgacgaguacggaaagccggaugagauccgcaucgagcucgcgcgggaguugaagaucggggccgccgagcgcgagaacaugacccgguccaucaaccagggcaaugccgagaacaagcgcauacgggagauccuggagaaggaguucgcucucagcuacaucucccgcaacgacaucaucaaguacaagcuguacgaggagcuuaagagcaacggguucaagacccucuacuccgacacguacauaagcaaggacaagcuguucuccaaggacuucgacaucgagcacauaauccccaaggcccggcuguucgacgacagccucuccaacaagaccaucgaggcccgcgaugucaacaucgccaagucuaacaagaccgccuuugacuuuaucuccgagaaguacgaccaacaagggaucgaggcuuacaagaaaaagcuggacauacugcuccaggacggcagcaucuccaaggccaaguacaaccggcugcugaugaaggaggccgacaucccgagcggauucaucgaccgcgaccuccgggacacccaguacauagccaagaaggccuacgagauccuguccgaccuggugcgcaacgugacgcccaccaccggcgcggucaccagccggcuccgcgaggacuggcaguugguggacgugaugaaagagcuaaacuucgagaaguaccagaagcucggccugguggaagugaucgaggaccgcgacgggaggaagaucaagcgcaucaaggacuggaccaagcggaacgaccaccgccaccacgccauggacgcacugacgaucgccuucaccaagccgagcuacauacaguaucucaacaaccugaacgcucgguccgacaagaacagcuccaucuacggcaucgagaacaaggagcugcaccgcgaggacaacaagcuccgguucaacgcgccccugcccaucaacgaguuccgggccgaggcccgucgccaucucaagagcauccuggugagugucaaggccaagaacaaggugaugacccagaacgugaacgucaucaagaccaagcacggagugaucaagaaggugcaacugacgccccggggagagcugcacaacgccaccuucuacgggaccaagaagagaccgauaaucaagauggucaaggugggcgccgcccucgacgaggugaccaucaagaaggucagcuccagcuucauccgugaggcccugcuggaccgccuccacgaguauaacggcgacgcuaagaaagcguucaccgggagaaacuccaucgacaaaaaccccaucuacaucgaugaggagcacaagaagaccgugcccgcucuggugaagaccaucgaaugggagauguaccaccccacacgcaagcugaucagcccggaccucaagaucgacaaggucauugacaagggcauccgggagauccugaagacgcgccuggccaaguucaacggggacgcccaaaaggcauucuccaaccucgacgagaaccccaucuacaaggacgaggcgaagaagauuacucugaagcgggugagccuggagggcguguccagcgucauaccucuccacacccugaaggaccgcgaggggaagcugguagugggcaaggacggcaagccgguccuaggggacuacgugcagaccuccaacaaccaccacaucgccuucuauauggacgaaaauggcaacuugcaggacaauguggucagcuucuucgaggccgccgagcggaagucucaggggguucccgucaucgacaagaacuauaaccacgauaagggcuggaacuuccuguucacgaugaagcagaacgaguacuucgucuuccccaacgaagugaccggguucaaccccagcgagguggaccuaauggacgaggcgaacuauuccaucaucagcccgaaccuguaccgcguccagaagaugagcaaggcguccggacgcgacuacugguuccggcaccaccuggaggccaugcucaacgacgaccccaagcugcgcaacucuauguucaagcggaucaccucccugaaggcccucgagggcaucgugaaggugcguaucaacugcaucgggaagauagucgccgugggcgaguacgacuga

SEQ ID NO: 7814 - RNA, 4128 nt, Artificial Sequence
  Cas9 variant
augagcaacaagagcuacaguaucggccuggacaucgggaccaacuccgugggcugggccgucaucaccgacgacuacaaggugcccucgaagaagaugaaggugcucgggaacacggacaagcacuucaucaagaagaaccugaucggcgcccugcuguucgaugaggggaccaccgcggaggaccgccggcugaagcgcaccgcccggcgccgguacacgcgccggaagaaccgccugcgguaccuccaagagaucuucucccaggagaucagcaaggucgacuccagcuucuuccaccgccuggacgacuucuuccuggugccggaggacaagcggggcuccaaguaccccaucuucgccacccucguggaggagaaggaguaccacaagaaguuccccacaaucuaccaccuccgcaaacaccuggccgacagcaaggagaagaccgaccuccggcugaucuaccuggcccucgcgcacaugaucaaguaccgcggccacuuccuguacgaggaguccuucgacaucaagaacaaugacauccagaagaucuucagcgaguucaucuccaucuacgacaacaccuucgagggcaagagccuguccggacagaacgcccaggucgaggccaucuucaccgacaagauaagcaaguccaccaagcgggagcgcgugcucaagcuguuccccgacgagaaguccaccgggcuguucagcgaguuccucaagcugaucgugggcaaccaggccgacuucaagaagcacuucgaccuggaggagaaggcgccgcugcaguucagcaaggacacguaugacgaggaccuggagaaccugcucgggcagaucggcgaugacuucgccgaccuguuucuggucgccaagaagcuauacgaugccauccugcugagcggcauccucaccgugaaggaccuguccaccaaggcgccccugagcgccuccaugaucgagcgguacgagaaccaccagaaggaccucgccgcccugaaacaguucauccagaacaaccugcaggagaaguacgacgagguguucagcgaccaguccaaggacggguacgccgguuacaucgacgggaagaccacgcaggaggccuucuacaaguacaucaagaaccuucugagcaaguucgagggcgcggacuacuuccuggacaagaucgagcgcgaggacuucuuaaagaagcagcggaccuucgacaacggcuccaucccucaccagauccaccuccaggaaaugaacgccaucauccgccggcagggggagcacuaucccuuccugcaggagaacaaagagaagaucgagaagauccuaaccuuccgcaucccguacuacgucggcccucuggcccgcgggaacggcgacuucgccuggcugacccggaacagcgaccaggccauccgccccuggaacuucgaggagaucguggaccaggcguccagcgccgaggacuucaucaacaagaugacgaacuacgaccucuaccugcccgaggagaaggugcugccgaagcacucccugcucuacgagaccuucgcggucuacaacgagcugaccaagguuaaguucaucgccgaagggcugacccgguaccaguuccucgacaagaagcagaagaaggacaucuucgacacguucuucaaggccgagaacaagcgcaaggugaccgagaaagacaucauccacuaucugcacaacgucgacggcuaugacggcaucgagcugaaggggaucgagaagcaguucaacgcgagccucuccaccuaccacgaccugcugaagaucaucaaggacaaggccuucauggacgacagcaagaacgaggagauccucgagaacaucauccacacccugacgaucuucgaggaccgggagaugaucaagcagcgccuggcccaguacgacucccucuucgacgaaaaggugaucaaggcucuuacccggcgccacuacaccggcugggggaagcugagcgcgaagcucaucaacggcauucgggacaagaaguccgggaagaccauccuggacuaccugaucgacgacggcgagaucaaccgcaacuuuaugcagcucauccacgacgacggccugagcuucaaggagaucauccagaaggcccagguguucgggaagacgaacgaugucaagcaggucgugcaggagcugcccggcucccccgccaucaagaaggggauccuccagagcaucaaaauagucgacgagcuggugaaggucaugggccacgcccccgagagcaucgugaucgagauggccagagaaaaccagaccacugcccgcgggaagaagaacucccagcagcgguacaagcgcaucgaggacagccugaagaaccucgccuccggccuggacagcaacauccugaaggagaacccgaccgacaacauacagcuccagaacgaccggcuguuccuguacuaccuccagaacggccgcgacauguacacggggaagccccuggagaucaaucagcuguccaacuacgacaucgaccacaucaucccccaggccuucaucaaggacgacagccucgacaaccgggugcugaccuccagcaaggacaaccgcggcaaguccgacaacguccccagccuggaggugguggagaagaugaaggccuucuggcagcagcuccuggacuccaaacugaucucggagcggaaguucaacaaccucaccaaggccgagcgcgagcgcgggggccugaacgagcuggacaaggucggcuucaucaagcggcagcucguggagacccgccagaucaccaagcacguggcgcaguuccuggacgcccgguucaacaaggaggucacggagaaggacaagaagaaccgcaacgugaagaucaucacccugaaauccaaccucgugagcaacuuccggaaggaguucgggcuguacaagguacgcgagaucaacgacuaccaccacgcccacgacgccuaccugaacgccgugcucgcgaaggccauccugaagaaguacccgaagcuggagcccgaguucguguacggcgacuaccaaaaguacgaccuccagcgguacauuuccaagagucgcgagcccaaggaagucgagaaggccacccagaaguacuucuuuuacuccaaccugcugaacuucuucaaggaggaggugcacuacgccgacgggaccaucgugaagcgagagaacaucgaguacagcaaggacacgggcgagaucgcauggaacaaggagaaggauuucgccaccgucaagaaggugcucagccugccccaggugaacaucgucaagaagaccgaggugcagaccgggggcuucuccaaggagagcauccugccgaagggcaauuccgacaagcucaucccccguaagacgaaggagauucugugggacaccaccaaguacggcggcuucgacagccccguaaucgccuacuccauccugcucaucgccgauauugagaaggguaaggccaagaagcugaagaccgucaagacguuagugggcaucaccaucauggagaaggcgaccuucgaaaagaaccccaucaccuuccucgagaacaagggguaccacaacgugcggaaggagaacauccugugccugccgaaauacagccucuucgagcuggaguccggccgccggcgcaugcuggccagcgccaaggagcuccagaagggcaacgagaucguccugcccguguaccugacgacccuccuguaccacuccaagaacgugcacaagcuggacgagcccgagcaccucgaauacauccagaagcaccgguacgaguucaaggaccugcugaaccucgucagcgaguucagucagaaguacguguuagccgacgccaaccuggagaagaucaagaaccucuacgcggacaacgaacaggcagacaucgagauccuggccaacagcuucaucaaccugcucaccuucaccgcccugggggccccggcggccuuuaaguuccugggcaaggacgucgaccgcaagcgguacacgaccgucuccgagauccucaacgccacccuaauccaccagagcaucaccggguuguacgagacgcgcaucgaucucuccaagcugggcgaggacuga

SEQ ID NO: 7815 - RNA, 4128 nt, Artificial Sequence
  Cas9 variant
auggagaagaaguacucaauuggccuggacaucggaaccaacucagugggcugggcggucaucaccgacgacuacaagguucccagcaagaaguucaaggugcucgggaauacgaacaggaagaguaucaagaaaaaccugaugggcgcccugcuguucgacagcggggagaccgcggaggcuacccggcugaaacgcaccgcccggcgccgguacacgcgccggaagaaccgcauccgguaccugcaagagauauucgccaacgagauggcaaagcucgacgauuccuucuuucagcgccuggaggagagcuuucuugucgaggaagauaagaagaacgagcggcaccccaucuucggaaacuuggccgaugagguggccuaccaccgcaacuaccccaccaucuaucaucuccggaagaagcuggccgacucccccgagaaggcggacuuaagacugaucuaccuggcgcucgcgcacauaaucaaguuccggggccacuuccugaucgaggggaagcugaacgccgagaacagcgacgucgcaaagcuguucuaccagcugauccaaaccuauaaccagcuguucgaggagagcccccucgacgagaucgaggucgacgccaagggcaucuuauccgcgcgccuguccaagucgaagagacucgagaagcugaucgccguguucccgaacgagaagaagaacgggcuguucggcaacaucauagcccucgcacuggggcugacccccaacuucaagucuaauuucgaccucacggaggacgccaaacugcaacugagcaaggacaccuacgacgacgaccucgacgaguugcugggccagaucggcgaccaguacgcggaccucuucuccgcagccaagaaucugagcgacgccauccugcucuccgacauccugcgcagcaacuccgaagugaccaaggcgccccugucugcuagcauggucaagcgguacgacgagcaccaccaggaccucgcccuacugaagacccucgugcgccaacaauucccagagaaguaugccgagaucuucaaggacgacacgaaaaacgguuacgccggauaugucggaaucggcaucaagcaccggaagcgcaccaccaagcuggccacucaggaggaguucuacaaguucaucaagccgauccuggagaagauggacggcgcggaggaguuacuggccaaauuaaaccgcgacgaccugcuccggaagcagagaacguucgacaacgggucuaucccccaccagauccaccugaaggagcugcacgccauccuucggcgccaggaggaguucuaccccuuccugaaggagaaccgggagaagaucgagaagauccugaccuuccgcaucccuuacuacgucggcccgcucgcccgggggaacagccgcuucgcguggcugacucggaaguccgaggaggccaucacacccuggaacuuugaggaagugguggacaagggcgccagcgcccagagcuucauugagcgcaugacuaacuucgacgagcagcugcccaacaaaaagguccuccccaagcacagccugcuguacgaguacuucaccguguacaacgaacucaccaaggugaaguacgucacagagcggaugcgcaagccggaguuccuauccggggagcagaagaaggccaucguggaccuccucuucaagacgaaccggaaaguaaccgucaagcagcugaaggaggacuacuucaagaagaucgaguguuucgacagcguggagaucaucggcguggaggaccgcuuuaacgccucccuggguaccuaccaugaccuccugaagauuaucaaggauaaggacuuccuggacaacgaggagaacgaggacauccucgaggacaucguccugacccucacgcuguucgaggaccgggagaugaucgaggaacgccugaagaccuacgcccaccuguucgacgacaaggugaugaagcagcucaagcggcgccacuacacaggguggggccggcugagccgcaagaugauuaacgggauccgcgacaagcaguccggcaagaccaucuuggacuuccucaagagcgacggguucaguaacagaaacuucaugcagcugauccacgacgacagucugacguucaaggaggagaucgaaaaggcgcaggucuccggccagggcgacucccuccacgagcagaucgccgaccuggcggggucccccgcuaucaagaagggcauccugcagaccgugaagaucguggacgagcuggucaaggugauggggcacaagcccgagaacaucgugauugaaauggcccgcgagaaccagaccaccacgaagggccugcagcagagccgggagcgcaagaagcggaucgaggaagggaucaaggagcuggagucccagauccucaaggagaaccccgucgagaacacccagcugcagaacgagaagcuguaccucuacuaccugcagaacggccgcgacauguacguggaccaggagcuggacaucaaccgguuaagcgacuacgacguggaccacauugucccgcagagcuucaucaaggacgacuccaucgacaacaaggugcugacccgcagcguggagaaccguggcaagucggacaacguccccagcgaggagguggugaagaagaugaagaacuacuggcgucagcuucucaacgccaagcucaucacccagcggaaguucgacaaccugaccaaggccgagcgcgggggccucucggaggccgacaaagcgggguucaucaagcggcagcuggucgaaacgcgccagaucaccaagcauguggcccggauccuggacagccgcaugaacaccaagcgggacaagaacgacaagccuauccgcgagguaaaggucaucacacucaagucuaaguuagugagcgacuuccggaaggacuuccagcuguacaaggugcgcgacaucaacaacuaccaccacgcccacgaugcguaccucaacgcgguugugggcacggcccugaucaagaaguaccccaagcuggaguccgaguucguguacggcgacuacaaggucuacgacgugcggaagaugaucgccaagagcgagcaggagaucgggaaggccacggccaagcgcuucuucuacuccaacaucaugaacuucuucaagaccgaggugaagcucgcaaacggcgagauccgcaagcggccgcugaucgagacuaacggggagacaggugaggucguguggaacaaggagaaggacuucgccacagugcgcaagguccuggccaugccucaggugaacaucgugaagaagaccgagguccagaccggaggcuucucgaaggaguccauccucagcaagcgggaguccgccaagcugaucccacgcaagaagggcugggacacccggaaguaugggggcuucgggagccccaccguggccuacuccauccugguggucgcgaagguggagaagggcaaagccaagaagcucaaaagugugaagguucugguggggaucaccaucauggaaaaggguagcuacgagaaggacccgaucggcuuccuggaagccaagggguacaaggacaucaagaaggagcuaaucuucaagcugcccaaguacucccuguucgagcucgagaauggccgccggcgcaugcuggccagcgccaccgagcugcagaaggcgaacgagcucgugcucccccagcaucugguccggcuccuguauuacacccagaacaucuccgccaccaccggcagcaacaaccugggcuacaucgagcagcaccgcgaggaguucaaggaaauauucgagaagauuaucgacuucuccgagaaguauauccucaagaacaaagugaauagcaaccugaaguccagcuucgacgagcaauucgccguguccgacagcauccugcucuccaacagcuucgucucccugcugaaguauaccucguucggggccucugggggcuucacguuccucgacuuagacgugaagcaagggcggcugcgcuaccagaccgugaccgagguccucgacgcgacccugaucuaccaaagcaucacgggccuguacgagacccggaccgaccucucccagcuagggggcgacuga

SEQ ID NO: 7816 - RNA, 4128 nt, Artificial Sequence
  Cas9 variant
augaagaagauccugggccucgaccuggggacgaccagcaucggcugggcccuggugaacgaguccgagaacaaggacgagcagagcuccaucguccgccucggggugagagucauaccccugacagucgacgagaagggcaacuucgagaaggggaaggccaucaccaccaacgcggaccggcagcagguccacgccgcgcggaucaacuuacagcgcuacaagcuccggcgcgagaaccugcgcgacugccuacagaagcagggcuggaucgguagcgagccgaugugcgaggacggcaagaguagcaccuucgagacguacaagcuccgcgccaaggcagcuguggaggaggugucccugcacgaguucgcgcgggugcuguucaugcuaaacaagaagcgcggcuacaagagcaaccggaaagccaacgacaaggaggaagggaagcuguucgauggaaugaccaucgccaagaagcuguacgaggagcacuuaacccccgcggaguacucccugcagcugcucaacaccgggcgcaaguucacgcccgaguacuaccggagcgaccugaucgaggaguucgagaagaucuggaacgaacagcagaaguacuaccccgagauccugacggacgaguucaagcagcaacucgagggcaaggccaaguccaacaccagcaagcuguuccugggcaaguacgggaucuacuccgccgacaccaagggacucgaccgccgcuugcagccccugaaguggcgcguggaggccaugaagcagcaggucgacaaggacgugcucgccuuugugaucagcgaccugaaggggcagaucgcgaacacgagcggccugcucggcgccaucagcgaucgguccaaggaguuguacuucucuaagcagaccauagggcaguaccugugggccucgcuccaagagaacccccacaucagcaucaagaaccagcccuucuaccgccaggacuaccuggacgaguucgagaagaucugggagacccaggccacauaccauaaggaacugacgagcgagcucaagcaggagauccgggacaucaucaucuucuaccagcgcccccugaagucaaagaagaaccugaucgccgucugcgagcucgagcagcggaaggugaaggugaccgucgacggcaaagagaaggagaucaccaucgggccgaagaucgcgcccaaaagcucccccauguuccaggaguuccgcaucuggcagaacuuaaacaacauacugcugcuggaccacgagaccaacagcaaacgcccccuguacgaagaggagcggaaccuccuguacgaggagcuuuccgugaaggagaagcucucaaagacggaggcccugaagguuuuaggcaagaaauccaaacagugggaccugaauuacaaggagcucgaggggaaccgcacccaggccguccuguacgacugcuacaaccggauaaucgugaugagcggccacgaggagugcaacuucaagaagcucaaggccuccgacauccgccauuacgugaagaugaucuucaagaaccucgccuucaacaccgacauccugugcuucgacuccucccugaagggccacgaacucgagcggcagccgaugugccagcuguggcaccuccuguacagcuacgagggggacaacucccgcaccggcaacgacgcgcugcuacggaagcucgagacuagcuucggguuccccaaggaguacgccgccguccuggccgacgugaucuucgaggacuccuacggcaaccugagcgugaaggccaugcgcaacauccucccccaccuccaggcagggaaggacuacucgcaggccugugaggaggccggcuauaaacacagccggcgcucccugaccaaggaggagcugaaccagaaggucuacaaggagaagcuggagcugcuccccaagaacagccugcauaacccgguggucgagaagauauugaaccagauggugaacgugaucaacgccgucaucgaggaguacggcaaacccgacgagauccggaucgaguuggcgcgcgaccugaagaucggggccgcugagcgugagaacaugacccgcucgaucaaucagggcaacgccgagaacaagcggauccgcgagaucuuagagaaggaguucgcccucucguaccuaagccggaacgacauuaucaaguacaagcucuacgaggagcucaaguccaacgguuucaagacccuuuacagcgacacguacauauccaaggauaagcuguucagcaaagacuucgacaucgaacacaucauccccaaggcgaggcuguucgacgacucccucagcaacaagacgaucgaggcccgggacgugaacaucgccaaguccaacaagaccgccuucgacuucauucuugagcgcuauggcgaacagggggugaagaccuacaagacgaagcuccugcgccugcucgaggacggcgccaucagcaacaagaaguacaacaaccugcugaagaccgaggcggacauacccuccggcuucaucgaccgggaccuccgcaacacccaguacaucgccaagaaggccuacgagauccucagcgagcuggucaagaucgugaccccgacgaccggguccgugacuaaccggcuccgcgaggacuggcagcuggucgacgugaugaaggaguuaaauuucgagaaguaccagaagcucggccuagccgacgugaucgaggaccgggacgggcgcaaggucaagcggaucaaggacuggaccaagcgcaacgaccaccggcaccacgcaauggacgcgcugaccaucgccuucacgaagcccagcuacauacaguaccucaacaaccugaacgcccgauccgacaagagcuccagcaucuacggcauugaggugaaggagcugcacagggaggagggcaaguuccgcuucaacgcuccccuccccaucaacgaguuccgggccgaggccaagcgucaccucaaaagcgugcuggucucaauaaaggccaagaagaaggugaugacccagaacgugaacaagaucaagaccaagcaugggaucaucaagaagguccagcugaccccgaggggcgagcugcacaacgcuacguauuacgggaccaagaagcgcccccuggugcggauggugaaggucggcgccgcgcuggacgaggccacgaucaagcgcgugugcagccccgcaauccgggccgcccugcugaagcgccucaacgcguauaacggggacgccaaggaggccuucaccggccggaacuccaucgacaagaaucccaucuaccuggacaucgaacagacgaagcuggugccaguccucgugaagaccaucgaguggggcauguaccaccccaucaggaagcgcaucacccccgaccucaaaauagacaaggugaucgauaaggggauccgggagaagcugaaagcccgccucgccgaguuuaacggcgacgcgcagaaggccuucucaaaccuggacgagaacccgauuuacauggacgaggccaagcggaucacacugaagcgcgucaguaucgagggggugcucagcgccaucccccugcacacgcugaaggacaaggcgggcaagcccgugaucggguccgacggcaagcccgucuuuggcgacuacguccagaccagcaauaaccaucacaucgccuucuacaucgacgacaaggggaaccuccaggacaacccgguguccuucuucgaggcggccgagcgcaagagccagggcguccccgugaucgaccggcgguacaauugcgacaagggguggcacuucguguucaccaugaagcagaaugaauacuucgucuuucccaacgaggccaccggcuucauucccucagagguggaccugcuggacgaggcgaacuacugcaucaucagcccgaaccucuacagagugcagaagcuguccaaggccagcgggcgggacuacugguuccgccaccaccuggagacgaugcucaacgacgaccugcggcugaagaacuccaccuuuaagcgcauccagagccucaagggccuggaggacaucgucaaggugcggaucaacuccaucggcaaaaucguggcgguugggaaguacgacuga

SEQ ID NO: 7817 - RNA, 4128 nt, Artificial Sequence
  Cas9 variant
auggagaccaaguucacguacuaccugggccucgacauggggacggacagccugggcugggccgugaccgacuccagcuaccacauccugagagccaaggggaaggaucucuggggcguccggcuguuccccgcggccgagaccuccguggaccgcagaaccuaccgugugaaccggcgcagacgccagcgggaaguugcacgcauuggggcccugaaggagcuguuugccgaugagaucgagaagguggacccgggcuucuucgugcggcuagacgagagcaaguuccacauggaggaccgcuccgagaacaacaagcagaaguacggccuguucgcggauaagcuguucagcgaugccgaguauuacaagaaguaccccacgaucuuucaccuccggaaggagcuccucgagucggaggaaccacaugacguacggcugguguaccuggcccuccugaacauguucaagcaccgggggcacuuccugaacagcucccuccagaucgaaggcgagaacaguaacaucgccgagucguaccagauguucguggacacccugaaggacgaggagcuggacuucccugaacaggucagcggggagcgacuccaggagauuuuucggagcagugacucccgcaagaagaagguggagaaccugcuggcagagaugaaccucagcaagaagcagaagcgggagauccaguucgugaaccugaucugcggccugaaggggaagcucuccgagcuguucccggacaaggaauacgacgaggaacagaagaaaaucgcauucagcuuccaggacuccgacuacgaggacaaggagaacaccauccaggagcuacucgacgagagcgaaaugaacaugaucuacgccgucaaggccgugcacgacagcggcgugcuauccggaaucaugaacggggagcgcuaccugagcguugcccggguggcguccuacgaaaagcacaagaaagaccuccagauccugaaggacauccugaagaaauacgacaccaaggaguacuucgagauguuccgcaacgagagcgagaaguccgagaacuacagcgccuacgugggcuccgucaaguaccacgggacguuccgcaggggccucagcggcgggaagcaggaggaccuguacaaacacaucaagaaggugcugggcaaguucccccaggacgacgagggggugaccuacguccucgaggagaucgagaccgaaucauuccugccgaagcagcugaccgccagcaacggcgugauccccaaccaggugcacgccagggagaugcucgcgauccugaagcacgcggagcuguaccucccguuccugcaggagaaggaugacacggggcuguccgucagcgagaagauccucaagcuguucauguuccagauccccuauuacgugggaccccugggacaggaguacaaggacaagaagggauacaacgucugggccgagcggaaggaacccggcaagaucuaccccuggaacuucgaggaaaagauagacgugaagaagagugcugagaaguucaucggacgcauggugcggcgcugcacuuaccugagcggcgagcaggcccuccccaagcagagccugcuguacgagaaguuucagguccucaacgagcucaacaaccugcggauccgcggcgagaaaauccccgugagcuugaagcaggagaucuaccaugaccuguucggcgacggcaagaagguguccaugacacggcugaccaacuaccuccugcaaaacggggucaucagcuccgaagagaaggacagcugcaucagcggcauugacgggggcuuccacaacucccugagcuccguggggaaguucaaggguguguucggcgacacgguccacaccgacgagcaccgcaagaugaucgaggacaucauauucugggggaccguguucggggacggcaagaagcuccugaaggagaagguggaggagguuuacggcaaccagcugaccgaggcccagaagaaacgaaucuucggcuucaaguucagcgguuggggccgcuuguccaaggcguuccugacgauggagggugcgucaaaggacaacggcgaaaucaaggggcugauccaggccaugugggacaccaacugcaaccucauggagcugcugagugagcgguucaccuacaaggacaagcucaacgaaauggugaccacggccgagaagccccugugcgaauggaagaucgaggaccuggacgagauguaccucagcgccccggugaagcguauggucuggcagacgaucagagugguggacgaggugcagcaaaucaugggcugcccgcccaagcgcauuuucguggagaugacccgguccgacggcgaaaaggggaagcgcaccgugagccggcagaagaaacuugucgaccuguacaaggcgcucggcaaggaagggaagaucuggucagaggagcugaacaacacgcccgagggucaguuccgcaucaagaagcucuaccucuacuaccugcagauggggaaguguauguacaccggcgagagcaucgagcuggagccccucaugaacgacaaccaccucuaugacaucgaccacaucuacccccgccacuucaucaaggacgacaacaucuccaacaacuuggugcuagugaagaaggaacgaaacgcccacaagagcgacucguuccccaucgagcccgagauccgcaacaagaugaugccguucuggaagucccugcggaagaagggcuuccugaccgaggagaaguacaaucgcuuaacacggaugagcgccuucacugaugaggagaaggccgcguucaucucucgccagcuugucgagacuagccaggggaccaaggccaucacccagaucuucaagcaggccuucgccgacuccgagauuguguucagcaaggccuccguggucagcgcguuccggcagaaguucgacuguuacaagguucgcugcgugaacgacuaccaccacgcccacgacgcguaccugaacaucgucgccggaaacacguaucgggugaaguucaccuccaacccccucaacuucaucaaggaggccaagaagaacccgaacucucgcgagaaccgauacaacauggacaagaccuucgagugggacgugacccgcaacggggagacugcgugggucgcacagucuaacgagaaccccggcacgauucagcuggugaaaaaguaccugaacaagaacucaccgcucaucaccaagaugguguacgaaaagcacggaggcaucacccagaaggccaccaucugguccgccaagaaggccgagagcggcaacacggacgcguacauccccguaaagaugaacgacccccggcuggccgacgugacaaaguacgggggcgugaccaccauugccgucgcgggguauacgcugcuugaguacaaggcgggcgggaagaccgugcgcucccuggaggcccugccgaucuaccucggcggcagcaagaaucugaccgaggagcagaugguggaguacuucuccaacauccugcagcaggagaacaaggagaaagucgugagcgacgugaucauccggaagaagaugauacccuccgggagcuuaaucaaguauaacggcuucuacuacuaccuggccgggaaaaccggcaaccgcauaguucugaucuccgccgugcaacucugucugcccauggauacgaugcuguacaucaagaagaucgagaaggccugcagcaccggcaacuucgaggagaaggacaagaacgggaagcagguccucuccaaacagcagaacgaguuuguuuacgagcugaucaucgagaaguaccagcagagcaucuucaagaagaaggugggcgcgaucggggacaccaucaucgagaagcgggagaaguucgccgagaucagccucgaggagcaguguaaagugcucaugcagauuuuccugaacuuccaguccgguauaggggucgaccugaccagcguggacggcuccaacaagagcggcgucacguaccucaacaagaagaucaugaacgcccaggagcugaagcugaucgaccaguccgugacugggguguucagccgcgagaucgaccuccugaccaucuga

SEQ ID NO: 7818 - RNA, 4128 nt, Artificial Sequence
  Cas9 variant
augucuaacaaguccuacuccaucggccuugacaucgggaccaacucugugggcugggccgucauaaccgacgacuacaaggugcccagcaagaaaaugaagguguuagguaacacggacaagcacuucaucaagaagaaccuuauaggcgcccuccuguucgacgaagggaccaccgcggaggaccgccggcugaagagaaccgcccggcgccgguacacgcgccguaagaaccgccugcgguaccuccaggaaaucuucuccgaggagaugagcaaagucgacuccagcuucuuccaccgccuggacgacuccuuccuggugccggaggauaagcggggcagcaaguaccccaucuucgccacccucgccgaggagaaggaguaccacaagaaguuucccaccaucuaccaccuccggaagcaccuggcggacuccaaggaaaagaccgaccuccggcugauuuaccuagcgcucgcccacaugaucaaguaccgcggccacuuccuauacgaggagagcuucgauaucaaaaacaacgacauccagaagaucuucuccgaguucaucagcaucuaugauaacacguucgaggaguccucgcugaucgggcagaacgcccaggucgaggcaaucuucaccgacaagauuucaaagagcgcgaagcgggagcgcguccucaagcuauuccccgaccagaaguccaccggucuguucagcgaauuucucaaacucauccuggggaaccaggccgacuucaagaagcacuuugaccucgaggagaaagcgccgcugcaauuuagcaaggacaccuaugacgaggaccuggagaaccuccugggccagauucgggacgacuucgccgacuuauuccucgucgccaagaagcuguacgacgcgauacugcuguccgggauccugacggugaaggaccuuagcacgaaggcgccccucuccgccuccaugaucgagcacuacgagaaucaccagaaggaccuggccgcccuaaagcaguucauccagaacaaccuccaggaaaaauacgacgaggucuucuccgaccaaagcaaagacggcuacgccggcuacaucaacgggaagaccacacaggaggccuucuacaaguacaucaagaacuugcuguccaaguucgagggcgccgacuacuuccucgacaaaaucgagcgcgaggacuuccuucggaagcagcgcacauucgacaacgggagcaucccccaccagauucaccuccaggagaugaacgccaucuugcaccggcaaggcgaacacuacccguuccuuaaggaaaacaaggagaagaucgagaagauccuuaucuuccgcaucccguacuacgugggcccccuggcacgcggaaaccgggacuuugcguggcugacccgcaauuccgacgaggccauccggccuuggaacuucgaggagauuguggacaaggccaguuccgccgaggacuucaucaacaagaugaccaacuacgaccuguaccugcccgaggagaagguucucccgaagcacagccugcuguacgagaccuucgcuguguacaacgagcucacgaaggugaaguucaucgcggaaggccugacccgcuaccaguuucuggacaaaaagcagaagaaagacaucuucuacacuuucuucaaggccgaggacaaacggaaggucaccgagaaggacauuauccacuaccuccacacgguggacggguacgauggcaucgagcuggaggggaucgagaaacaguucaacgccucccugagcaccuaccacgaccuccugaagaucaucaaggacaaggaguucauggacgacgacaagaacgaggcgauacuggagaacaucgugcacacacucaccauauucgaggaccgcgagaugaucaagcagcgguuggcgcaauauaacucccuguucgacgagaaggucaucaaggcccucacgcgccggcauuacacuggcuggggcaagcugagcgccaagcugauaaacgggauccgugauaaaaaguccggcaagacgauccucgacuaccugauugacgacggggagaucaaccggaacuuuaugcagcugauccaugacgacggacucagcuucaaggagaucauccagaaggcccagguguucgggaagaccaacgacgugaagcagguugugcacgaacugcccggcagucccgcgaucaagaagggcauccugcagagcaucaagaucguggacgagcucgucaaggugauggggcacgcacccgagagcaucgucaucgagauggcccgcgagaaccaaacgaccgcccggggcaagaagaacucccaacagcgcuacaagagaaucgaggacagccugaagaaccuggccuccgggcucgacuccaacauccugaaggagaacccgaccgacaacgugcagcugcagaacgaccgccucuuccuguacuaccugcagaauggucgggacauguacacugggaagccccucgagaucaaucagcuguccaacuacgacauugaccacaucaucccccaggccuucaucaaagacgacagcuuagacaaccgaguguuaacguccaguaaggacaaccgcggcaaguccgacaacguccccagccuggaagucguggagaagaugaaggcguucuggcagcaguuacucgacuccaaacuuaucagcgagaggaaguucaacaaccugacgaaggccgagcgcgagcggggcgggcuaaacgagcuggauaaggucggcuucauaaagcgccagcugguggagacacggcagauaaccaagcacguggcacagauccucgacacccgcuucaacaaggaagucacggagaaggacaagaagaaccguaaugugaagaucaucacccugaaguccaaccuggugagcaacuuccgaaaggaguucgggcucuacaaggucagggagaucaacgacuaccaccacgcccacgacgccuaccugaacgcggugguggccaaggcuauccugaagaaguacccgaagcucgaaccugaguuuguauacggcgaguaccaaaaguacgaccucaagcgcuacaucucccguagcaaggacccaaaggauaucgagaaggccaccgaaaaguacuucuucuacucuaaccuacucaacuucuucaaggaggaaguacaguacgccgauggcaccaucgcuaagcgcgagaacaucgaguacagcaaggacacaggggagaucgccuggaacaaggagaaggacuucgccacagugaagaagguccugagccugccccaagugaacaucgugaagaagagagagguccagaccggcggguucuccaaggagagcauccucccgaagggcaacuccgacaagcuaaucccccgcaaaaccaaggauauccugugggagacgacgaaguacggcggguucgacagccccgugaucgccuacuccauccuccugaucgcggacaucgagaaaggcaagagcaaggagcugaagaccguaaagacucuagucgggaucacuaucauggagaaggccaccuucgaggagaaccccaucaccuuccuggaaaacaaggguuaccauaacgugcggaaggagaacauccuuugccucccgaaguauucucuguucgagcuggagaacgggcgacggcgccuccuggccagcgccaaggaauuacagaagggcaacgagaucguccuccccgucuaccugaccacgcugcucuaccacuccaagaaccuucacaagcuggacgaacccggucaccucgaguacauccagaagcaccggaacgaguucaaggaccugcugaaccucgucagcgaguuuucccagaaguacauccuggccgacgcgaaccuggagaagauccagaaccucuacgccgacaacgaacaggcggacaucgagauccuggccaacagcuuuaucaaucugcucacauucacuacccugggggccccggcggccuucaaauucuucgguaaggacaucgaccgcaagcgguauacgaccguguccgagauccugaacgcuaccuugauccaccagagcaucaccgggcuguacgagacccgcaucgaccuguccaagcucggcgaggacuga

SEQ ID NO: 7819 - RNA, 4128 nt, Artificial Sequence
  Cas9 variant
auggagaaguccuacagcaucggccucgacaucgggaccaauagcgugggcugggccgucaucaccgacgacuacaaggugcccgccaagaagaugaaggugcucgggaacacggacaagaaguacaucaagaagaaccugcugggcgcgcuccuauucgacuccggggagaccgccgaggucacacgccugaagcggaccgcucgccggcgcuauacgcggcgcaagaaccggcucagguaccugcaagagaucuucgccaaggagaugaccaagguggacgagagcuucuuccagcggcuggaggagucuuuccucaccgacgacgacaagaccuucgacagccacccgaucuucggcaacaaggccgaggaggacgcguaccaccagaaguuccccacgauauaccaccuccgcaaguaccuggccgacucccaggaaaaggccgaccucagacugguguaccuggcccucgcgcacaugaucaaguaccggggccacuuccugaucgagggggagcugaacgcggagaacaccgacguccagaagcuguucaacguguucguggagaccuacgacaagaucgucgacgagagccaccuguccgagaucgagguggacgccagcuccauccugaccgagaaggugagcaagucccggcgccucgagaaccugaucaagcaguaccccacggagaagaagaacacccuguucggaaaccucaucgcccuggcucuggggcuccagccaaacuucaaaaccaacuuuaagcugagcgaggacgcgaagcugcaguucuccaaggacaccuacgaggaggaccucgaggagcugcugggcaaggucggggacgacuacgccgaccucuucaucagcgccaagaaccuguacgacgcgauccugcucuccggcauccugacgguggacgacaacagcacuaaggccccgcuguccgcgagcaugaucaagcgguacguggagcaucacgaggaccucgagaaguuaaaggaguucaucaagaucaacaagcugaagcucuaccacgacaucuucaaggacaagaccaagaacggcuacgccggguacaucgacaacggcguuaagcaggacgaguucuacaaguaccugaagaccauccugacgaagaucgacgacagcgacuacuuccucgacaagaucgagcgcgacgacuuccugcggaagcagcgcaccuucgacaacggguccaucccccaccagauccaccuccaggagaugcauagcauccugcggcgccagggugauuacuaccccuuccugaaggagaaccaggccaagaucgagaagauccugaccuuccggauccccuacuacgugggcccgcuggcccgcaaggacucccgcuucgccugggcgaauuaccacagcgacgagccuaucacccccuggaacuucgacgaggugguggacaaagagaaguccgccgagaaguucaucacgcggaugacccucaacgaccuguaccugcccgaggaaaaagugcucccgaagcacagccacguguacgagaccuucaccgucuacaacgagcugacgaaaaucaaguacgugaacgagcagggggaguccuucuucuucgacgccaacaugaagcaggagaucuucgaccauguguuuaaggagaaucgcaaggucaccaaggccaagcugcucagcuaccugaacaaugaguucgaggaguuccggaucaacgaccugauuggccucgacaaggacuccaagagcuucaacgccucccuggggaccuaccacgaccuaaagaagauccucgacaagagcuuccuggacgacaagaccaacggccagaucaucgaggacaucgugcugacgcucacccuguucgaagaccgcgacaugauccacgagcggcugcagaaguacuccgacuucuucaccagccagcagcucaagaagcuggagcgccgccacuacaccggguggggccgccuguccuacaagcucaucaacggcauccggaacaaggagaacaacaagacgauucuggacuuccugaucgacgacgggcacgcgaaccgcaacuucaugcagcucaucaacgacgagagccugucguucaaaaccaucauccaggaggcccaggucgugggcgacguggacgacaucgaagccgucguucacgaccugcccgggagccccgccaucaagaagggcauccuccagagcgugaagaucgucgacgagcuggugaaggugaugggcgacaaccccgacaacaucgucaucgagauggcacgggagaaccagaccaccggcuacggccgcaacaagagcaaccagcggcugaagcgccuucaggacagccugaaggaguucgggagugacauccugagcaagaagaaaccguccuacguggacagcaagguggagaacucccaccuccagaacgaccgucuguuccuguacuacauccagaacggcaaagacauguacaccggggaggagcucgacaucgaccgccugagcgacuacgacaucgaccacaucaucccccaggccuucaucaaggacaacuccaucgacaacaagguccugacgagcuccgccaaaaaccggggcaagagugacgacgugcccuccaucgagaucgugcgcaaccggcgcagcuacugguacaagcucuacaaguccgggcugaucagcaagcgcaaguucgacaaccugaccaaggccgagcggggcggucucaccgaggccgacaaggcgggguucaucaagcgccagcuggucgagacccggcagaucacgaagcacguggcccagaucuuagacgcccgcuucaacaccaaacgggacgagaacgacaaggugauccgcgacgucaaggugaucacccucaaguccaaccuggugagccaguuccggaaggaguucaaguucuacaagguccgcgagaucaacgacuaccaccacgcccacgacgccuaccugaacgcggucgugggcaccgcccuccugaagaaguaccccaagcugacgccggaguucgucuacggggaguacaagaaguacgacgugcggaagcucaucgccaaguccagcgacgacuauagcgagaugggcaaggccaccgccaaguacuucuucuacuccaaccugaugaacuucuucaagaccgaagugaaguacgcggacggccgcgucuucgagcggcccgacaucgagacaaacgccgacggggaggugguguggaacaagcagaaggacuucgacaucguccgcaaggugcugagcuacccccaggugaacaucgucaagaagguggaggcccagacgggcggguucuccaaggagagcauccucuccaagggcgacagcgacaagcugaucccccggaagaccaagaagguguacuggaacaccaagaaguacgggggauucgacuccccgacagucgccuacagcgugcugguggucgcggacaucgagaagggcaaggccaagaagcucaagacggugaaggagcugguggggaucuccaucauggagcgcagcuuuuucgaggagaaccccgucuccuuccuggagaaaaagggcuaccacaacguacaggaggacaagcucaucaagcugcccaaguacagccuguucgaguucgagggcggccggcgccggcuccuggccuccgccaccgagcugcagaaggggaacgaggugaugcuccccgcccaccuggucgagcugcucuaccacgcgcaccgcaucgacagcuucaacuccaccgagcaccugaaguacgugagcgagcacaagaaggaguuugagaaggugcuguccugcgucgagaacuucagcaaccucuacguggacgucgagaagaaccuguccaagguccgggccgccgccgagagcaugaccaacuucagccuggaggagaucuccgccagcuucaucaaccuccugacgcugaccgcgcucggcgccccggccgacuucaacuuccugggggagaagaucccgcgcaagcgguacaccuccaccaaggagugccugagcgccacgcucauccaucaguccgugaccgggcuguacgagacccgcaucgaccugagcaagcucggcgaagaguga

SEQ ID NO: 7820 - RNA, 4128 nt, Artificial Sequence; identical to SEQ ID NO: 2020
  Cas9 variant

SEQ ID NO: 7821 - RNA, 4131 nt, Artificial Sequence
  Cas9 variant
augagcaacuuugacaaccacaaggacuccauuuguaagcacaagggccugaagaaggggaacuacuacaucgggcuugauaucgggaccaacagcguggguugggccgccacaaacgagcaguacgagcugcuuaaguucaagucccacaagauguggggaagccgccucuucgcggaggcccagaccgccgucgacacccgaaugaagcgcuccgcccggcgccgucugcagcgccggaaguuccgccugauccuccuggagagccuguucuccaaggagaucaacgcuguagacgagaccuucuucaugcggcuccacgagagcaacuaccacguggaggacaagaccaaccugguuaaguacacgcuguucaucgacaagaacuacaccgacgucgacuacuacaaagaguuccccaccaucuaccaccuccgccaccaccugaugaccgaggggacgaaagacauccggcugcuuuuccuggcgauacaccauauccugaaguaccgcggcaacuuccucuacgggaagaaggaguucuccguggacggcgaaauguacagcguccugcgcuccacccuggaggagcucggguuugguucuuacguggaagacgagaacguucugcaauccaucgccaaccugguccucgaccgagggaucgccagaagcgagaaggugaagcagaucgagccgcuaaucgcccagggcaagaagcuguccagcguggagaagaaccgccucaaggcgugggccuaccugaucauggggcugaaggccaaccucgucaaccuguucaccgacgaggacguggaggucguccugcccgaggagaaggaguuuaaguccaucaaccuccacgaggggaucuacgaggacgugcgggacgccuacgaggacgccuggggcgaccgcuucgcgaucguggaccaaugcaagguccugcacgacaucaucgugaucagcuccaucaucaagcccgggcagagccuaagcgaggccaagaucgaguccuacaaccagcacaaggaggaccucgugcugcucaagucgguccucaaggaggauaagaagcuguacgacgacauguucgugguggacaucgacaaggggaccaacuacgucaaguacaucaagcagggcgugaacgggaacacguccaccacacaggaggcguucuacaaauacguccggaaagugguguccguccugcccgagaccgagaacacgcgcuguaucgugcagaagcucgaggaggguaccuuccugccgcugcagcggaucuccaagaauggggugguccccuaccagcuccacaaggaggagcugguacgcauccuggagaaagccaagcucaacuuccccuuccugaacgagguggaggacgggcugaccgucgccgacaagaucaucucuauccuggaguucaagaucccauacuacguggggccucucaaccccacccacuccaucgagaacggcggcuucgcgugggugguccgaaaggaagccggccagguucuccccuggaacuucgagcaaaagguggauguccaggccucugcagugaaguucaucgagaaccugacgaacaagugcaccuaccucauugaccaggaugugcugccuaaguacucccuucucuacgccgaguuuagccugcugaacgagcucaauaacauccgggucaacgacaagccgcugccugcggacgugaagcaggcuuucauucgcgaccacuucaucucccugcaggacagcaagaccgccaccaagaagguggucgccaaguaccucguggacaacaacuacgugucccagccgccaaucaucacggggauggaccagcagaucgcuaccaagcugaccagccaccgggacaugaccagaauccugggggagcacuucgacuacgcgauggccgaggacaucauccgguacauaacgaucuucggggaguccaaggacaugcuccgccagguccugaagaacuacuacggagaccggcucaccacggagcagaucaagaagcucggcaagcugaccuacacgggaugggggcgccuguccaagaaguuccucuccgacaucuggggcaugaaaaagaacgacgacgacgccgaggccgggaccaucauugagcacaugcgggagggccaggagaacuuaaugcagcugcucaguuccagcuacagcuucaucgacguggugcaggaguacguuaccaacgugcugggcgcgaaagagaagaccgccuucgagaugcuagaggaucucucacugagcccuauggugaagcguuccgucuggcagacccugcggauccucgacgaaaucgugagcauccgcaaggagcugcccaagaagaucuucguggaggucgcccggaccaacaaggccgacaagaagcgcacccagucccggaaggcccugcucgaggaacuguacgagcaaaucaaggacgaggacguccacgugcuucagcaggagcucgagagcaaggaggacuccgcgcugaacagcaaaaagcuguaccucuacuucacucagaugggccgcugcauguacaguggccggcgcaucgacauccacgagcuguucaccgacacguacgacaucgaccacaucuacccacggagccugaccaaggacgacuccuggcacaacaucguccucguggagaagcagcugaacgcggagaagaccgaccgcuuccccauccugagcgcaauucaguccaagcagaagggguucuggaagcugcuaugggaccgcggcuucaucagcgagaagaaguacgaccggcuggugcgcaccacggaccucaccgacgaagaacugaaccaguucaucaaccggcagaucgucuccacuaaucagagcgugaaagccgugacaacacugcuccaccagcuguacccggagaccgaggucguguucuccaaggccgaaaacaucagcgacuuccgccgggauuacggguucgugaagguccgcagcaucaaccaccaccaccacgcgaaggacgccuaccuuaacaucguggugggcaaugucuaccacgagaaauucaccaagaacuuccucuccuucgcuaagcagaagggcacccaccggacguacaaccugaccaagauguucgaguacgagauuaagcugaccgaggagagcaagaaggugaucugggaccccaacauccauauggacaucgugaaaaagaugaugaaguccaacgacguccgcguuacccagcgggccgucccccagaagggcgggcucagugacgagacgauauacaagaaggggaucgccaagcgcggagucuacuuaccccugaaguccagcgacgagcgggugcgcgauguggagaaguacgggggccggacauccaucacuaucagcgaguacaucauccucaacauccgcgacaccuccgaccaggaccggaucgagaucuucagccugccguuguacaucgcggggaagaaggacauacacaaggccaucgaggaggccuaccucuccacgugcaagaagccugccagcgugguggacauccagauccuauaccgcgggcuguacauaggcuccaaggucaacaucaacggguucacauacuacaugggcgggaagaccggcagcaacguguccguggacagcgcggucgacgugguuauggauaucaccuccagcgucuacaucaagcuacuggagaaaguggccaucaagaagaucgagaacuccaagacguuccggaucgaaaacaucaagaccagcuacaaccacaaggaggugaccgucagcaaggagcagaacaucgcccuguaccaggaacuccugaaaaagcuggacacgccccucuucucuaagaugaagggcaacaaacuggaggaguuccgcaccgugggguucgacaccuucauagcccugagccucgaggaccaagccuccgugcugcuggagguccucaaugugcugaccaauuucaagaccaagcgggacaucacgaagaucggcaugaccagcucccgaagcacccuggggaucaacaucuccaacaccgagcaauucagugugaucacgacuuccaucaccggccucuacgagcaggagaucaagaucaaguga

SEQ ID NO: 7822 - RNA, 4131 nt, Artificial Sequence
  Cas9 variant
augaccaccaagaaccgcgagaagaacaacaaguuccacaaggccagcccccuguacacgcucggccuggacaucgggaccaccuccgugggcuucaccgccaucgacgaggcgcagcggccgaugcgcgccaaggggaaaacggucaucggcgugcggcuguuccaagaggggcagagcgccgugggccgcaagaacuuccggaccacccgccggcgccucaagcggcgucggcgccggcugaaccugcucaagcaguucuucuccgcgccccugcgcaagaucgaccccaccuucuucaagcggcugaaggccagcucccucagccccgccgauaagcgccgguaccuggccccgggccuguuccccaacgggggcgacaucaaguucuaccagaaguaccccacgaucuaccaccuccgccuggcccuuaugaccgagaagcggcccuucgaccuccgcgaggucuaucuggccauacaccacaucgugaaguaccgcgggaacuuccugaacccgcuccccguguccgcguuccgcggcagaaaccagcgguucgaggaccaguucagcgagcugaaccagcuguacaagucccucgagggcgagagccccuuccaguucgacgagaagauuuucuccgagcuggacaagcagcugcucgucaacgacggccgcaagaucgaccggcagaagcagcuggccaagcgcguguucaucaagaccaacgagaagcgcaucgauagccaccaccagaagaucgccuccgccuucagcaaggccguuuucggcuacaaguuccgccccgacguccuacucaacuccgacccgaacgagucaauugacgaguucaucaaguucggggacgaggacuucgacgacaaguuagugauucugcgggagucccucaacgcgacccagaaggagauccuggccgugacgcagcgcaucuacagccaaaucauccugaacgagaucguccccucccgggagacccucagcgaggccauggugagccgcuaccagaagcaucacuccgaccugcagcugcucaccgaggccugcaagaagaugaccaaggccaaggcggcccggauccaggccgccuacacggacuacaucggcaagggggacggccacaagcuggugcacgaccaguucgucgcccugaucaagaagaaccucgaccccucagaggagggccgcgaccuggcggagcggcuggcccaggacgacuucaugccccuccagcgcaccccgcugaaccgggugaucccccaccagcugcagcaggaggagcucgaccgcaucaucgagaaccagggggaguacuaucccuuccugaagacacugaaccccaaccggucccgcgccggcguggccaacuaccagcucgacgagcuggucagcuuccggauccccuacuacguggggccccugaucaccgccacggaucagcugcacaccuccggcgcgaaguucgccuggaugacccgccgcgccgccggggagaucacccccuggaacuucgaccagaagguggaccggcucgcgagcgccaaccaguucauccgccagaacaugcccaaggacaaccaccuccuggaggccgacguccugccggccaacucccugacguaccagcgguaccuggugcucgacgagcugaacgccgugaaggucaaccacaagagccugaccgugucccagaagcagcgcaucuucaacgaccucuucaagcggcagcgcaccgucaccgugcuuaacuugcagaacuaccucaagagcaucgagaagcugcccacgcugcccgugaucaccggcgucagcgacagcgagcgguucaagaccacccucuccacguaccuggacuucaagaacaucuucggcgggaagguggacgacagcucccagaaggagaaguucgagaagauaauccuguacgcgaccaucuucgaggaccacgccgucuacaaggccaagcucgaccagaucgacuggcugggccagcagcagaagaccgaccugcucagcaagaacuaccaaggguggggccagcuguccgagaagcugcuccuggggcugaagaaccaggccggccaaucgauccucgacgagcuguggcagacuaacaaacgcuuccgggagaucaugaacgaggcccacuucgcgaaacagaucauggccuccaacgccgcccugcuccgcaagaagggucuggacgacguccugagcacggccuuccucagcccccagaacaagaaggcgauccggcagaccguggagguggucgacgacaucgugaaggccaucgguugcccgccccagaagaucucccuacacuucaguaaggcccccgccgacgcgauccgccacgagcgggacaacgccaacaucauccugcgcaccuaccggaaccucccggccaagaugguggacgaccagcugaaggccgagcugcaggccaccgcggagaagcaccagguccucuccgacaagcuguaucuguacuucacccagcucggccgcgaccuguacaccggagagaugcugaagaugagcgagcucgagaacgacaugaucgaccacaucaugccgcagaccuucgccuacgacgacuccguaaacaaccgggugcucgucagccagaaccacuccagccaguuaggcaagaccuccggugagaaguccgaugccaaaaugauccgcuucuggcagguccuccgcgacaacaagcugaucagcgagcaaaaguaccagaaccugacccucgacagcgaccaccuguccaagagcacccgcgagcagcugcucaaccgguaccugguggagaagaaccccaucacccaguggguggccuccgugcugaccgagaaguacggcgacaacggcacccgcgugcucacgaucaacccccgcauggucuaccagaugcggcggcaguucaaccuggugaaccugccggaggugaacgacuacgaccacgggcucgacgccuaccuggcggccuucaucggcaacuacgucgaccgccgcuacccccggcugagaagcuacuucguguacggggacuucuccagcucaaaggagaucguguuccggcucaaccgauucaacuuccuguucgaccugggccaggccgagcccaacgagcucaccgacugggagaccggcgagaugaucugggacaaggccgccgcgaacuccguccugcgggacguguaccaguauaaguucaugcugaucagccaggccguguacucccgccagggggccauguucaaccagaccaucuaccccgccucucaggcggccggccggcagcucauaccggucaagaagaaccgcgccacuaagcuguacgggggcuacuccgggaacguggacgccuaucuggccaucgugcggcucggcggccccaagagcgaccaguaccgcgucguggggauccccacccggauggugggccgcuuacaauccgcgaugaagcagggggccgacaccuacgccaacacccugcacaagauccuccagccccaguucacgaagcggaagaagaaccgccagaccggcuacuacgaggagaccaccgagccauuugccgucauccuggacaaaguguacuaccggcagcugaucaucgacgggcagcagaaguucaugcucggaagcuccacguaccaguucaacgccaagcaguuggugcugagcucccgcgcgcgccagauucucagcggcgaggagcgccugaccgacgagaacgggucccaggaccugaucgacgucuacgacgagauccucaccaagaucgaccgcuacuucgaacuguacgaccagcggcacuuccgccagucacugcacgacggccggaagcaguucauuucccuacccauccacaauguguaccgcgccaaccggcuaaucgagcacgggaaguacgagacccugagccagauccucaacggccugcacgccaacacgaugaugaccaaccugagauaccuugggaucuccagcccauucggcaaguuccagucucccaacggcaucaagcugagcaaagacgccgugcuggucuaccagagccccuccgggcuguucgagcggcgcgugcggcuccgcgaccuguga

SEQ ID NO: 7823 - RNA, 4131 nt, Artificial Sequence
  Cas9 variant
augaacaacaagcccuacagcaucggccucgacaucgggacgaacuccgugggcugggccgucaucaccgacgacuacaaagugccgagcaagaagaugaaggugcucggcaacacggacaagcacuucaucaagaagaaccugcugggcgcccuccuguucgacgaggggaccacagcggaggaccgccggcugaagcgcaccgcccggaggcgguacacgcgccggaagaaccgccuccgguaccugcaggagaucuucacagaggagauguccaaggucgacaucagcuucuuccaccgccucgacgacucguuccucgugcccgaggacaagcggggcagcaaguaccccaucuucgccacccuggaggaggagaaggaguaccacaagaacuuccccaccaucuaccaccuccgcaagcaccuagcugauuccaaggagaaggccgacuuccggcugaucuaccuggcgcucgcccacaucauaaaguaccgcggccacuucuuauacgaggagagcuucgacauaaagaacaacgacauccagaagaucuucaacgaguucaucucaaucuacgacaacacguucgaggggagcucacugaacggccagaacgcccagguggaggccaucuucaccgacaagaucagcaaauccgcgaagcgggagcggguccucaagcuguucccggacgagaaguccacggggcuguucagcgaguuccucaagcugaucgugggcaaccaggccgacuucaagaagcauuucgaccuggaggagaaggcgccccuccaguucagcaaggacaccuacgaugaggaccuggagaaccugcucgugcagaucggugacgacuucgccgaccuguuccuggucgccaagaagcucuacgacgccauacugcuguccggcauccucacggugaccgaucccagcaccaaggcgccccuguccgccagcaugaucgaccgguacgagaaccaccagaaggaucuggcugcccucaagcaguucaucaagaccaaccugccggagaaguacgacgagguguucagcgaccaguccaaggauggguacgccggguacauugacggcaagacgacccaggaggccuuuuacaaguacaucaagaaccuucucagcaagcuggagggggccgacuacuuccuggacaagaucgagcgcgaggacuuccuccggaagcagcgcaccuucgacaacggcuccaucccccaccagauccaccuccaggagaugaacgccaucauccggcgccagggcgagcacuaccccuuccugcaggagaacaaggagaagaucgagaaaauccugaccuuucgcauccccuacuacgucgggccgcuggcccggggcaaccgcgacuucgcguggcugacgcggaacagcgaccaggccauccgcccuuggaacuucgaggagaucguggacaaggcccgguccgcagaggacuucaucaacaaaaugaccaacuacgaccucuaccugcccgaggagaaggugcugcccaagcacagccugcucuacgagaccuucgccgucuacaaugaacugaccaaggugaaguucaucgcggaggggcugcgcgacuaccaauuccucgacuccggccagaaacagcagaucgugacgcagcuguucaaggagaagcggaaggucaccgagaaggacaucauccaguaccugcacaacguggacagcuacgacgggaucgaacucaagggcauagagaagcaguucaacgccucccugagcaccuaccacgaccugcucaagaucaucaaggacaaagaguucauggacgacaguaagaacgaggccauccuggagaacaucgugcacacccugacgaucuucgaggaccgcgagaugaucaagcagcggcucgcccacuacgcgagcauauucgacgagaaggucaucaaggcacugaccaggcggcacuacaccgggugggggaaacucuccgccaagcucaucaacggcauuuacgacaagcagagcaagaagaccauccuggacuaccugaucgacgacggggagaucaaccgcaacuucaugcagcucaucaacgacgacggccuguccuucaaggagaucauccaaaaggcccagguggugggcaagacgaacgacgucaagcaggucgugcaggagcugccgggcucacccgccaucaagaagggcauccuccaguccaucaagcugguggacgagcuggugaaggucauggggcacgcgcccgagagcaucgugaucgagauggccagggagaaucagaccaccgcccgcggcaagaagaacucccagcagcgguacaagcgcaucgaggaugcuuuaaagaaccuggcccacgggcuggacagcaacauccucaaggagcaccccaccgacaacauccagcugcagaacgaccggcuguuccucuacuaccugcagaacggaaaggacauguacacgggaaagucccuggacaucaaccagcucagcagcugcgacaucgaccacauuaucccgcaggcguucaucaaggacgacucccuggauaaccgcgugcugacaagcuccaaggacaaccggggcaagagcgacaacguccccucccucgagaucgugcaaaagcgcaaggcauucuggcagcagcugcuggacagcaagcucaucuccgagcgcaaguucaacaaccugaccaaggccgagcggggcgggcuggacgagcgcgacaaggugggcuucaucaagcggcagcucgucgagacccgccagaucaccaagcacguggcccagauccuagaugcccgguucaacacggaggugaccgagaaggacaagaaggaccgaagcgucaagaucaucacccugaaguccaaccucgugagcaacuuccgcaaggaguuccgcuuguacaaggugcgggagaucaacgacuaccaccacgcgcacgaccccuaccugaacgccgucguugcuaaggccauccucaagaaguaccccaaacuggagccagaguucguguacggggacuaccagaaguacgaccugaagcgcuauaucucccggaccaaggaucccaaggaggucgagaaggcgacggagaaguacuucuucuacagcaaccuccugaacuucuucaaggaggaggugcacuacgccgacggcaccaucgugaagcgcgagaacaucgaguacuccaaggacaccggcgagauugcguggaacaaggagaaggacuucgccaccauaaagaagguccugagccucccccagguaaacaucgugaagaagacggaggagcagaccgucgggcagaacggcgggcuguuugacaacaacaucguguccaagaagaagguggucgacgccagcaagcugacccccaucaaaagcggccucuccccggagaaguacgggggcuacgcgcggcccaccaucgcauacucugugcuggucaucgccgacaucgagaagggcaaggccaagaagcugaagcgcaucaaggagauggucgggaucacggugcaggacaagaagaaauucgaggccaaccccaucgcguaccucgaggagugcggcuacaagaacaucaaccccaaccugaucaucaagcugcccaaguacucccucuucgaguucaauaacgggcagcggcgccugcuggccagcuccaucgagcuccagaagggcaacgagcugauugugcccuaccacuucacagcccugcucuaccacgcccagcggaucaacaagaucagcgagcccauccacaagcaguacguggagacccaccaguccgaguucaaggagcugcugaccgccaucaucagccucuccaagaaguacauccagaagccgaacguggagagccugcugcagcaggcguucgaccaguccgacaaggacaucuaccagcucagcgaguccuucaucagccuucugaagcucaucuccuucggggcccccggcacguucaaguuccugggcguggagaucagccaguccaacguucgguaccagagcguguccagcugcuuuaacgccacccugauccaccagagcaucaccgggcucuacgagacccggaucgacuuauccaagcugggcgaggacuga

SEQ ID NO: 7824 - RNA, 4131 nt, Artificial Sequence
  Cas9 variant
auggacaagaaauauggaauaggucuggacauagggacgucauccaucggcuggacugucguagauaaauaugggcacaucauccgcgucaaaggucaaacaggcaucggcguccggcuauuccgagaaggacaaacggccgcggagcgccgcaccuucagaaccacccguagacgcuuaucaaggcgcagauggcgacuucgccuccuucgugaaaucuuugacgagcccauuucagcuauagacgaaaacuucuucgccaggcaaaaagcaucaagccuagcaccgggcgacgcucguuaccaacaggcguuccagcuuuucaacgacaggaccgaccaggcauucuauugcaaauacccaacaaucuaucaccuccgccaagcccucaugacugaaucacgccaauucgauauccgagaaauauaccucgcccuacaccaaauaaucaaauaucgugggcauuuccuucugggcggcgcagccaaagacuuccaaucugacaaauuagaccucgaggccuacuucacaaccaucaacgcccagcuugcgggcaucuacagcgacggaagugugcaacugccgacccuagacuggaaccaagccugccaagagcucacagauacgagccgcacgcaauccgaccggaaaaauuggcuugucaaggaauuaaaaagcuacggcgacucccaacucaaaccaaucuacacucagauagccaacgcuauacucggcuuuaagacagaucucgcgaaaaucauggguaucaacgacccagaaaaagcacuauccuuuaaucucgacgcccuagacgaccaccgcgacgauguagcagaacuccuaacggacgaacaaauaccccucguuaaccugcuagccaagcuacacaccgcccuugagcuagcagccauccucccagacggccaaacacuauccggaaaaauggucgaaauuuacgaaacucaccgcaaacaguuaaaaacauacaaagccuucauacgucaacuaccagaccggcaacaacgacuggcacuuaaacaggccuacgaucacuacaucgaccaaggacucaaucgagaggcuuucuacucagaaguuaaagccauccucgaaaagcaaaaaccccucaccgccaccggacaagcgaugaagaaagcgauggaucaaaacgcuuuccuccuaaaacaacguacuaaaacgaacaucgccaucccauaccaaguacaacaacaagaaauggaccagauaaucgccaaucaaagcaaauacuacccauggcuggcaacgcccaacccagucaaaagcaggcgcgucauagcuccauacaaacucgacgagcuaguaugcuuucgcgucaacuacuacguaggcccucucguacaauccaagcccggugaagcgacuaaagaagccaaguucgcguggaugacccgcaaggacccacaaagcacggucgccauaacaccauggaacuucgaccaacagguagacagacaggcuuccgccaaugccuuuauccaaagaaugaagaccacagacaccuaccuccuaggcgaagacgugauacccaaaaacuccuugcuguaucaaaaauaugagguccuaaaugaacucaacaacguccgcgucaacggcgacuggcuugacccccaacggaagcaauaccucuucaagaaacucuuuauggaccagccccaaagcguagucacaguuaaagcacuccagaaaacccuggucguaauaggcgccugucccacgcuaccaaccguggaaggauuagccaaucccaaacgcuuuuuaagccaacuaaccacauaccacgacuucuguaaacuccuccccgaugacauucaacgcgccgaccgccaagcggacaucgaaaagauuaucaacuggagcacgaucuucgaagacacagccaucuucaaagaaaaacuucgggacaucaaguggcuaucagcggaucaaaucagaagacuaaguagccgcccccgcuauagaggauggggacgguucuccgcgaaacuccucugcggacuacacgaccggcaaggaaauaccgucauggacgaacucuggcaaacgucacgaaauuucaugcaaaucauaagacaaagugauuuccaaacagcgauagcugcugucaaccaacaagaccucggcaggcaagaccuccaacgcguaaucgacgaccucuacacaagcccgcagaauaagaaagccauccgacaaguacuagccgucguuacagacauccaaaaagcaaugcacggcaaagcaccuagcuggcucuuugucgaaguagcgaaaggagcccaaaagaacccccagaggacacaaagccgacaaucaaaauuagccgaggccuaccgcgaaucagcccgcgaguuaguggacgaggccgucaaagaacaguuacucacccugccagaugaccgccaaacauuuucggaccgccucguacuguacuuccagcaaaacgggcgcgacaucuacacgggggagccacucgacuucgaacgucuguccaacuaucacaucgaccacauaaucccacaagccguagugaaagacgauucccuggacaaccgcguacucacgucgaaccaagcaaaccucgagaaaggagcacacgucccaaccaucuuccgcgacaagcaagaaccaguuuggcaagaacucuaccgagucggauugauaagucacagaaagcugcggaaccuacucaccacacccgacgaccuagaugacagaggccgcgccaccgguuucaucgcccgucaacucgucgaaacuaggcagguuauaaagcuaguuauggagguccucucacaauacuaugacaccaccgaaaccgaacucauaagcaucaaagccggacucucccaccaauuccgccaggaacucaaccucccgaaacugcgcgcccuaaaugauuaccaccacgcccaagacgcauaccuggccgcacgaauaggcacauaccucuuacagcguuacccuaaccucaaacgauucuucguguacggcgacuucaagaaaacacacuucgaccuucagcgacguuucaacuucauaggcgggaugaucucccgagaaaaacaaccguacaaccuuaucaaaaaccccguaacgcaccaaguaauaugggacgaggaaauggaaauuggcgauugucaaaagaaaaauccagaacaaccaaaacacgacgccacggucaaaaugaugaaccucacuaaaauaaugaaccuaaaacacauccugguaacucacgaaguuuaugagaaccauggcgcgcuguucaaccaaacaauauacccagcaucccaagcacacaagaagaaacucauaccccagaaaaccgaaaaaccaauagaacuauacggagggcauagcagugagcaagcuggcuacauggcaauuauccgacuccucgguaaacgccccggcuacaaagucaugcggguacccgugcgcuacgucucacaacuacaacaccaagacguagccgaacaaaagaaacuccucuacaagaucuucguuucggagcuaacgagccgcaacaaagucaagccguucgagguagucgucccucacgucugccuaaaccaacccguugaagacaugaucaaagggcaauggcacagauucgcccuacgcacgaacggauacuaccaaaaccaacaacaacucaucuuaucccuagucgcccaaagaacacuagcaggauacaaacccaaggacgacgaacugauggccguauaccacgaaaucugcaagcaagugaaauacuacuuuccauuauacaaaaugaacaaauuucaaucccgccuauuugcagccgaagaacuccuacaaaagagaagcaccgucaacaguuuuagcaucaccaucggcaaaaacggaaaagaaaacaagacgcucaaucugggaaagcgagagcuucuccuacgacuacuaggcggccuacaugccaacgccacacgaguggaccugaaagacauaggcuguaccggccaauucggucagcuccaagugaaaaaugggaucaaacucacagaacaagccgugcuaauccacgagucaccaaccggucucuuccaucgucgaguacgacucaaugaccucuga

SEQ ID NO: 7825 - RNA, 4134 nt, Artificial Sequence
  Cas9 variant
augaccaagaagaacuacagcaucggccuggacaucgggaccaacuccguuggcugggccgucaucacggacgacuacaaggugcccgccaagaagaugaaggugcucgggaacaccgacaagaaguacaucaagaagaaccucuuaggcgcgcuccuguucgacucaggggagaccgcggaggccacccgccugaagcggacugccaggcggcgcuacacgcggcgcaagaaccggcuccguuaucugcaggagauauucgccgaggagaugaccaaggucgaugaauccuucuucuaccgacuggaugagagcuuccuaaccacggacgagaaagacuuugagcgccacccgaucuucggcaacaaggcggacgagaucaaguaccaccaggaguuccccaccauauaccaccuccggaagcacuuagccgacuccagcgagaaggccgaccugcgccugguguaccuggcccucgcgcacaugaucaaauuccggggccacuuccugaucgagggggagcugaacgccgagaauaccgacguacagaagaucuucgccgacuucgucgguguguacgaccgcacuuucgacgacucccaccucagcgagaucacgguugacgccgccuccauccugaccgagaagaucagcaagucccggcgccuggagaaccucaucaaguacuaccccaccgagaaaaagaacacgcuguucgggaaccugaucgcgcucgcacugggccuucagccuaacuucaagaugaacuucaagcucagcgaagacgccaaguuacaguuuuccaaggacagcuacaacgaagaccuggaagaacuccuggggaaaaucggcgacgacuacgccgaccuuuucacgucagccaagaaccucuacgacgcgauacugcugagcggcauccucaccgucgacgauaacuccaccaaggccccgcugagcgccuccaugaucaagcgguacgcggagcaccacgaggaccuggagaagcucaaggaguucaucaaggccaacaagagcgagcuguaccacgauaucuucaaggacgagaccaaaaacggguacgcgggcuacaucgagaacggcgugaagcaggacgaguucuacaaguaucugaagaacacgcucucgaagaucgccggcuccgacuacuuccuggacaagaucgagcgcgaagacuuccugcgaaagcagcgcaccuucgacaacggcagcaucccccaccagauccaucugcaggagaugcacgccauccugcggcgccagggggacuacuacccauuccugaaggagaaccaggaccgcaucgagaagauccucaccuuccggaucccuuacuacgugggcccgcucgcccgcaaggacucccgguucagcugggccgaguaccacuccgacgagaagaucacccccuggaacuucgacaaggucaucgacaaagagaaguccgcggagaaguucaucacgagaaugacccugaacgaccuguaccuccccgaagagaaaguguuacccaagcacagccacguguacgagaccuacgcagucuacaacgagcugacaaagaucaaauacgugaacgagcaagggaaggacagcuucuucgacuccaacaugaagcaggagaucuucgaccacguguucaaggagaaccggaaggugacgaaggagaagcuccugaacuaccugaacaaggaguucccggaguaccgcaucaaggaccucaucggccuggacaaggagaacaagagcuucaacgccucccuugggaccuaccacgaucucaagaagauauuggauaaggccuuccuggaugacaaggugaacgaggaggugauugaggacaucaucaagacccucacacuguucgaggacaaggacaugauccacgagcggcuccagaaguacagcgacaucuucacggccgaccagcucaagaagcuggagcgccggcacuacaccggcuggggccgccugaguuacaagcucaucaacgggaucagaaacaaggagaauaacaagaccauccuggacuaccugaucgacgacggcagcgcaaaccgcaacuucaugcagcucaucaacgacgacacucugccauucaagcagaucauccagaagucccaggucgugggggacguugacgacaucgaggcggucgugcacgaccugcccggcucuccagccaucaagaaggggauccuucaguccgucaaaaucguggacgagcuggugaaggugaugggcgacaacccggacaacaucgugaucgagauggcucgggagaaucagacgaccaaccgcggcagaagccagucccagcagcgcuuaaagaagcuccagaacagccugaaggagcuggggagcaacauccucaaugaggagaagcccuccuacaucgaggacaagguggagaacagccaccuccagaacgaccaacuguuccuguacuacauccagaacggcaaggacauguacaccggggacgagcuggacaucgaccaccuguccgacuacgacauugaccacaucaucccccaggcguucaucaaggacgacagcauugacaaccguguccucaccuccagcgccaagaaccgcggcaaguccgacgacgugcccagccuggacaucgugcgggcucgcaaggccgaguggguccgccuguacaaguccgggcucaucagcaaacggaaguucgacaaccugaccaaggccgagcgcggcggcuugacggaagcagauaaagccggguuuaucaagcggcagcucguggagacccgccagauuaccaagcacguggcucagauccuggacgcccgguucaacaccgaguccgacgagaacgacaaggucauccgggacgugaaggucaucacgcucaagagcaaccugguaucgcaguuccggaaggacuucgaguucuacaaagugcgcgaaaucaacgacuaccaucacgcgcacgacgcguaccugaacgccguggucggcaccgcccugcucaagaaguacccgaagcuggccagcgaguucguguacggggaguacaaaaaguacgacgugcacaaacuaaucgcgaaguccagcgacgaccacuccgagaugggcaaggccaccgccaaguacuucuucuacagcaaccucaugaacuucuucaagcgggucauucgcuacagcaacggcaagguuauugugcggcccgucguggaguacagcaaagacaccgaagacaucgccugggacaagaaguccaacuuccgcacgaucugcaaggugcugagcuacccccaggucaauaucgugaagaaaguugagacccagaccgggggcuucagcaaagaguccauccugcccaagggggacagcgacaagcucaucccgcggaagaccaagaaggccuacugggacacgaaaaaguacggcggguucgacucccccaccgucgcguacagcguguucguggucgccgacguggagaagggcaaggcgaagaagcugaagacggucaaggaacuggucggcaucuccaucauggagcgcagcuucuucgaggagaaccccguggaguuccucgagaacaagggguaccacaacauccgggaggacaagcugaucaagcugcccaaguacagucuguucgaguucgagggcgggaagcgccggcugcuggccagcgccuccgagcuccagaagggcaacgagauggucaucccggggcaccuggucaagcugcucuaccacgcgcagcgcaucaacagcuucaacuccaccaaguaccuggacuacgugagcgcgcacaagaaggaguucgagaaggugcuguccugcgucgaagauuucgccaaccucuacguggacguggagaagaaccugagcaagauccgggccgucgccgacuccauggacaacuucagcaucgaggagaucagcaacuccuucaucaaccugcucacgcugaccgcgcugggcgcucccgccgacuucaacuuucuuggcgaaaagaucccccgcaagcgguacaccagcaccaaggagugccugaacgcuacgcuuauccaccaguccaucaccgggcuauacgagacucgcaucgaccugaguaagaucggcgaggaguga

SEQ ID NO: 7826 - RNA, 4134 nt, Artificial Sequence
  Cas9 variant
augaagaagcccuacagcaucggccuggacauugggaccaacuccgugggcugggccgucaucaccgacgacuacaaagugccgagcaagaagaugaaggugcucgggaacacggacaagcacuucaucaagaagaaccugaucggcgcacugcuguucgacgaggggaccaccgcggaggaccgccggcugaagcgaacgucccggcgccgguacacgcgccggaagaaccgccuucgguaccuccaggagaucuucagcgaggagaucagcaagcuggacagcuccuucuuccauagacuggacgacagcuuccucguccccgaggauaagcggggcuccaaguaccccaucuucgccacccuggaggaagagaaggaauaccauaagaaauuccccacgauauaccaccuccgcaagcaccucgccgacagcaaggagaagaccgaccuccggcugaucuaccucgcccuggcccacaugaucaaguaccgcggccacuuccuguacgaggaguccuuugacaucaagaacaacgacauacagaagaucuucaaugaguucaucagcaucuacgacaacacuuucgagggguccucgcucuccggccagaacgcccagguugaggcaaucuuuaccgauaaaaucucaaaguccaccaagcgggagcgcgugcugaagcuguucagcgacgagaaguccaccgggcuguucagcgaguuccuuaagcugaucguuggcaaccaggcggacuucaagaagcacuuugaccucgaggagaaggccccgcugcaguucuccaaggacacguacgacgaggaccuggagaaccuccuggggcaaaucggcgacggcuucgcggaccuguuccucguggccaagaaguuauacgacgccauccugcuaagcgggauccugaccgugaccgaccccagcaccaaggcgccccuuuccgccagcaugaucgagcgguacgagaaccaccaggaagaccucgcggcacugaagcaguucaucaagaacaaccuguccgagaaguaugccgaagucuucagcgaccagaguaaggacggcuacgccggguucaucgacggcaagacgacccaggaggccuucuacaaguacaucaaaaaccuccugagcaaacuggagggcgcggacuacuuucucaacaagaucgagcgcgaagauuuccugcggaagcagcgcaccuucgacaacggguccaucccccaccagauccaccuacaggaaaugaacgccauccuccggcgccagggcgagcacuaccuguuucugaaagagaaccgcgagaagaucgagaagauccucgccuuccggauccccuacuacguggggcccuuggcccgcggcaaccgggacuucgccugguuaacccgcaauucggaccaggcgauccggcccuggaacuucgaggaggugguugacaaggccuccagcgccgaggacuucaucaacaagaugacgaacuacgaccuguaccuucccgaagagaagguacugccgaagcacucccugcucuacgagaccuucgccguguacaacgagcugacgaaggucaaauucaucgccgagggacugcgcgacuaccaguuccucgacagcggccaaaagaagcagaucgugaaccagcuguucaaggacaagcggaaggugaccgagaaagacaucauccacuaccugcacaacgucgacggcuacgacgggaucgagcucaagggcaucgagaagcaguucaacgcgucccugagcacguaccacgacuuacucaagaucaucaaagacaaggaguucauggacaaccccaagaacggggagauccuggagaacaucauccacacccugacaaucuucgaggaccgcgagaugauuaagcaacggcucgcccaguacgacacccuguucgacgagaaggugaucaaagcccugacgcgccggcacuacaccgggugggggaagcucuccgccaagcugauuaauggcauccgcgacaagcagaccggcaaaaccauccuggaguaccucaucgacgacggggacugcaaccggaacuucaugcaacugaucaacgacgauggccugagcuucaaggagaucauccagaaggcccagguggucgggaagacggacgacgugaagcaagucgugcaggagauccccggcucccccgcgaucaagaaggggaucuuacagagcaucaagaucguggacgagcuggucaaggugaugggccacaacccggagagcaucgugaucgagauggcgcgcgagaaucagaccaccgccaaggggaaaaagaacucccagcagcgguacaagagaaucgaggaugcccugaagaaccuagcgcccggacuggacagcaacauccugaaggagaaccccaccgacaacauccagcuccagaacgaccggcuguuucuguauuaccugcagaacggcaaggacauguacacgggaaaggccaucgacaucaaucagcuguccaacuacgacauugaccacaucaucccccaggccuucaucaaggacgacagcuuagacaaccgcguccucaccucaagcaaggacaaccgaggaaaguccgacaacgugccgagcaucgaagugguccagaagcgcaaggccuucuggcagcagcugcuagacuccaagcucaucagcgagcgcaaguucaacaaccucaccaaggccaagcggggcgggcuggacgagcgagacaaggugggcuucaucaagcggcagcuaguggagacccgccaaaucaccaagcacgucgcgcaacugcuagacacgcgguucaacaccgaggugaacgaggagaaccagaaaauccgcaccgugaagaucaucacccucaaguccaaccuggucucaaauuucagaaaggaguucggccuguacaaggugcgcgagaucaacgacuaccaccacgcccacgacgccuaccucaacgccgucgucgccaaggcgauccugaagaaguaccccaagcuggagcccgaguucguuuacggcgauuaccagaaauacgaccucaagcgguacaucuugaagucaaaggccagcaacacgaucgacaaggcgaccgaaaaguacuucuucuauuccaaccugcucaacuucuucaaagagaaggugcgcuacgccgaugggaccaucaagaagcgggagaacauugaguacagcaacgauaccggcgagaucgcguggaacaaggagaaggauuucgcaacgauaaagaagguccugucccugccccaggugaauaucgugaagaagacagaggaacagaccgucggccagaaugggggcuuauucgacaacaacaucgugucgaagaagaaggucgucgaugccagcaagcugaucccgaucaaguccagcuuaucccccgagaaguacgggggcuacgcucgccccacgaucgccuacagcgugcucgugaucgcggacaucgagaaggggaagggcaaggccaaaaaguuaaagaggaucaaggagaucgucggcauaacgauccaggacaaaaagaaguucgaguccaaccccgugaccuaccuggaggagugcggguacaagaacauuaacuccaaccucaucauuaaguugccgaaguacucccuguucgaguucaacgacggccagcgccggcuccuggcgagcuccaucgagcugcagaaggggaacgagcucauccugcccuaccaccugaccgcucuccuguaccaugcccagcgcaucaacaagaucagcgagcccauccacaagcaguacguggaggcgcaccagaacgaauuuaaggagcugcucaccacgaucaucuccuugagcaagaaguacauccagaagccgaacguugagcugcuccugcagcaggcguucgaccaggcugauaaggacauauaccagcuguccgagagcuucaucucccucuuaaagcugaccagcuucggcgcccccggggccuucaaguuucucggcguggagaucucccagagcuccgugcgguacaaacccaacagccaguuccuggacaccacacugauccaccagagcaucacgggccucuacgagacucguaucgaccuguccaagcugggggaggacuga

SEQ ID NO: 7827 - RNA, 4134 nt, Artificial Sequence
  Cas9 variant
augaacaacaagcccuacagcaucggccuggacaucgggaccaacuccgugggcuggagcgucaucaccgaugacuacaaggugccguccaagaaaaugaaggugcucgggaacacggacaaacgcuucaucaaaaagaaccugaucggcgcccugcuguucgacgaggggaccaccgccgaggcgcggcgccugaagcggaccgcccgccggcgcuacacgcggcgcaagaaccggcugcgcuaccuccaggagaucuucgccgaggagaugagcaaggucgacuccagcuucuuccaccggcuggacgacucauuccugauccccgaggacaagcgcggcagcaaguaccccaucuucgccacccucguggaggagaaggaguaccacaagcaguucccuacgauauaccaccuccggaagcaguuggccgacuccaaggagaaggcggaccuccgccugaucuaccuggugcucgcccacaugaucaaguaccggggccacuuccuguacgaggaggccuucgacaucaagaacaacgacauccagaaaaucuucaacgaguucaucagcaucuaugacaacaccuucgagggguccagccuguccggccagaacgcccaggucgagacgaucuucaccgacaagaucagcaaguccgcgaagcgcgagcgggugcucaaacuguuccccgacgagaagucuaccggucuguucagcgaguuccucaagcugaucgugggcaaccaagccgacuucaagaagcacuucgaccuggaggagaaggcgccgcuccaguucagcaaggacaccuaugacgaagaccuggagaaccugcucgagcagaucggggacgacuucgccgaccuguucgucgccgcgaagaaacuguacgacgccauccuccuguccggcauccugacggugaccgaccccagcaccaaggcgccccucagcgccucgaugaucgagcgcuacgagaaucaccagaaggaucuggccgugcugaagcaguucaucaagaccaaccucccggagaaguacgucgagguguucagcgaccaauccaaggacggcuacgccggguacaucgacggcaagacuacccaggaggccuucuacaaguacaucaagaaccugcugagcaaguucgacggggccgacuacuuccucgacaagaucgagcgggagguguuccugcgcaagcagcggaccuucgacaacggcuccaucccccaccagauccaccuccaggagaugaacaccauccugcgccgccagggcgagcacuaccccuucuugaaggagaacaaggagaagaucgagaagauccugacguuccggauccccuaccacgucgggccgcucgcccgcggcaacagggacuucgccuggcugacccgcaacagcgaccaggcgauccgccccuggaacuucgaggagaucguggacaaggccuccagcgccgaggacuucaucaacaagaugaccaacuacgaccuguaccuccccgaggagaaggugcugcccaagcauucccuccuguacgagaccuucgcagucuauaacgagcucacgaaggugaaguucaucgccgaggggaugcgcgacuaccaguuccuggacagcggccagaagaagaagaucaucaaccagcuguucaagaagaaaaggaaggugacugaggacgacaucaucgacugccuccagaaaaucgacaacuacgacgggaucgagcugaagggcaucgagaaacaguucaacgcgucccugagcaccuaccacgacauccucaagaucauccgcgacaaggaguucauggacgacccgaagaacggcgacauccuggaaaacgucauccacacccugacgaucuucgaggaccgggagaugaucaagcagcgccuggcucaguacaacuccaucuucgacgagaaggugaucaaggcccugagccggaagcacuacaccggguggggcaagcugucagccaagcucaucgacgggaucagagacaagcagaccggaaagaccauccuggacuaucugauggacgacggcaagagcaaucggaacuucaugcagcucaucaaggacgacgagcuguccuucacggagaucauccagaaggcccagguggucggggacaccgacaaccugcgccaggugguccagaaccucccgggcagcccagccaucaagaaggggauccugcaguccaucaagaucguggaugagcuggugaaggucaugggccacgccccugagagcaucgugaucgagauggcccgggagaaccagaccaccgcccgcgggaagaagaacagccagcagcgguacaagcgcaucgaggacucccucaagaaccuagcguccggccuggacuccaacauccucaaagagaacccgacggauaacauccagcugcagaacgaccggcuguuccucuacuaccugcagaacgggaaggacauguacaccggcgaggcccugaacaucaaccagcucagcuccuacgacaucgaccacaucaucccccaggcuuucaucaaggacgacucccuggacaaccgcgugcugaccuccagcaaggacaaccgaggcaagagugacaacguccccagccucgaggugguggagaagaugaaagccuucuggcagcagcugcuggacuccaagcucaucagcgagcggaaguacaacaaccuaaccaaggccgagcgcgagcgcgggggccugaacgagcuggacaaggucggguucaucaagcggcagcugguggagacccggcagaucacgaagcacguggcgcagauccuggacgcccgcuucaacaaggaggucaccgagaagaacaagaagaaccggaacgugaagaucaucacucucaaguccaacauggugagcaacuuccgcaaggaguucggccuguacaaggugcgggagaucaacgacuaccaccacgcccacgacgccuaccugaacgcaguggucgcgaaggccauccucaagaaauaccccaagcuagagccggaguucgucuacggcgacuaccagaaguacgaccugaagcgcuacaucucacggagcaaggaccccaaggagguggagaaggccaccgagaaguacuucuucuacuccaaccuccugaacuucuucaaggaggaggugcacuacgccgacgggacgaucguaaagcgcgagaacaucgaguacagcaaggacaccggcgagaucgcguggaauaaggagaaggacuucgccaccaucaagaaggugcugagccucccccaggugaacaucgucaagaagacagaggagcaaacgguggggcagaacggcgggcuguucgacaacaacaucguguccaagaagaaggucguggacgccagcaagcugauccccaucaaguccggccucagcccggagaaguacggcggguacgcccggcccaccaucgccuacuccgugcuggucaccuacaagcagaauaacaaaaucaagaacaccaugguggggauccccgugcuuacuaagcucgaguucgagcgcgacccgaaccuguaccugcggaacuuggggaucaacaacgucagccacgugaucaaguuagugaaguacaccgucuuggaguucaagcacaaauacgguaccuaccgccgguucaucguauccaaccaggagcugaagcgcgcgaaccagaucuucgugaccacgaagcagaugaagcugaucagccaguacaccacccuggacaagaacgagcacgacucccuccugaagaacaaccagcagcugauccagagcaucuggaaccaguuccucgaguucaugcuggccaccgaccuggucaacaagaagcaguacgacgagcucauccugacaaacaaccagaccaucgaggagugccggaacaucaugaaccgcgugaucaccacccuguccuucacgaacaucaacgccgggcagaagaagaucaucuucgacgacacccucagccugcccaucaagcgguggcaguucaccgacuccgacaagauggugaagaagaucaucgagagcacccugauacaccaguccaucacgggccucuacgagacccgcaucgaccugagcaagcugggcgaggacuga

SEQ ID NO: 7828 - RNA, 4134 nt, Artificial Sequence; identical to SEQ ID NO: 2028
  Cas9 variant

SEQ ID NO: 7829 - RNA, 4134 nt, Artificial Sequence
  Cas9 variant
augaacaagcccuacaguaucggccuggacaucgggaccaacuccgugggcuggagcaucaucaccgacgacuacaaggucccggccaagaagaugcgcgugcucgggaacacggacaaggaguacaucaagaagaacuugaucggcgcgcugcuguucgacgggggcaacaccgcggccgaccggcgccugaagcggaccgcccgccggcgcuacacucggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgcaacgaugcaggaggagaaguacuaccacgagaaguuccccaccaucuaccaccuccggaaggagcuggcagacaagaaggagaaggccgaccugcgccucguguaccuggcccuggcccacaucaucaaguuccgggggcacuuccucaucgaggacgaccgcuucgacgugcggaacaccgacauccagaagcaguaccaggcguuccuggagaucuucgacacgacguucgagaacaaccaccuccucucccagaacgucgacguggaggccauccugaccgacaagaucagcaaguccgccaagaaggaccgcauccuggcccaguaccccaaccagaaauccaccggcaucuucgcagaguuccucaagcugaucguggggaaccaggcggacuucaagaagcacuucaacuuggaggacaagaccccgcuccaguucgccaaggacagcuacgacgaggaccuggagaaccugcucggucagaucggggacgaguucgccgaucuguucagcgucgccaagaagcuguacgacuccgugcuccugagcggcaucuuaacggugaccgaccucucgaccaaggcgccccugagcgccuccaugauccagcgguacgacgagcaccacgaggaccugaagcaccucaagcaguucgucaaggccagccugcccgagaauuaccgcgagguguucgccgacuccagcaaggacggcuacgcuggguacaucgaaggcaagaccaaccaggaggcuuucuacaaguaccugcugaagcuguuaacgaagcaggaggggagcgaguacuuccucgagaagauaaagaacgaagacuuucugcggaagcagagaaccuucgacaacggcaguaucccccaccaggugcaccugaccgagcuccgcgcgaucauccggcgccagagcgaguacuacccguuccugaaggagaaccaggaccggaucgagaagauccugaccuuccgcauccccuacuacgucggcccccucgcccgggagaagucugacuucgccuggaugacgcgcaagaccgacgacagcauccggcccuggaacuucgaggaccugguggacaaggaaaaguccgccgaggccuucauccaccgcaugaccaacaacgacuuguaccugccggaggagaaggugcuccccaagcacagccugaucuacgagaaguucacugucuacaacgagcugacgaaggugcgguuccucgcggagggguucaaggacuuccaguuccugaaccgcaagcagaaggagaccaucuucaacucccuguucaaggagaagcggaaggugaccgagaaggacaucaucagcuuccucaacaaggucgacggcuacgaggggaucgcaaucaagggcaucgagaagcaguucaacgccucccugagcaccuaccacgaccugaagaagauccucgggaaggacuuccuggacaacacggacaacgagcugauccucgaggacaucgugcagacccugacccuguucgaggaccgcgagaugaucaagaagugccucgacaucuacaaggacuucuucaccgaaucccagcugaagaagcuguaccggcgccacuacacgggcuggggccggcucagcgccaagcugaucaacgggauccgcaacaaggagaaccagaagaccauccuggacuaccucauagacgacggcuccgcgaaccggaacuucaugcagcugaucaacgacgacgaccugagcuucaagcccaucaucgacaaggcccgcaccgggucccacagcgacaaccucaaggagguggucggcgaacuggccgggucccccgccaucaagaagggcauccugcagagccucaagaucguggacgagcuggucaaggugaugggcuacgagccggagcagaucguggucgagauggcacgggagaaccagaccacggcgaaggggcugucccgcagccgccagcggcucaccacccugagagagagccuggccaaccucaaguccaacauccuggaggagaagaagcccaaguacgugaaggaccaggucgagaaccaccaccugagcgacgaccgccucuuccuguacuaccugcagaacggccgggacauguacaccaagaaggcccucgacauugacaaccugucccaguacgacaucgaccacaucaucccccaggccuucaucaaggacgacagcaucgacaaccggguccugguguccagcgccaagaaccgcggaaaguccgacgacgugcccagcaucgaaaucgucaaggcgagaaagauguucuggaagaaccuccuggacgccaagcugaugucccagcgcaaguacgacaaccucaccaaggcggagcggggcgggcugacguccgacgacaaggcccgcuucauccagcggcagcugguagagacccgccagaucaccaagcauguggcccggauccucgacgagcgauucaacaacgaggucgauaacggcaagaagaucugcaaggugaagaucgugacccugaaguccaaccuggucuccaacuuccggaaggaguucggcuucuacaagauacgcgaggugaacgacuaccaccacgcgcacgacgcguaccucaacgccguggucgccaaggcgauccugaccaaguacccgcagcuggagcccgaguucguguacgggauguaccgccagaagaagcucuccaagaucgugcacgaggacaaggaggagaaguacagcgaggccacccgcaagauguucuucuacuccaaccugaugaacauguucaagcgggucgugcgcuuagccgacggaagcaucgugguccggcccgugaucgagaccgggcgcuacaugcgcaagaccgccugggacaagaagaaacacuucgccacggugcggaagguccucuccuacccccagaacaacaucgugaagaagaccgagauccagaccggcggcuucagcaaggagagcauccuggcgcacgggaacuccgacaagcugaucccgcgaaagaccaaggacaucuaccucgaccccaagaaguacggcggguucgacagccccaucguggccuacuccguccuugucguggccgacaucaagaagggcaaggcccagaagcugaagacggucaccgagcuccugggcaucaccaucauggagcggucucgcuucgagaagaaucccagcgccuuccuggagagcaagggcuaccucaacauucgggacgacaagcugaugauccugccgaaguacucccucuucgagcuggagaacgggcgccggcgccugcucgcgagcgccggggagcugcagaagggcaaugagcuggcccuccccacccaguuuaugaaguuccuguaccuggccucccgguacaacgagagcaaggggaagcccgaggagaucgagaagaagcaggaguucgugaaccagcacguguccuacuucgacgacauccuccagcugauaaacgacuucagcaagcgcgucauccuggccgacgcgaaccucgagaagaucaacaagcuguaccaggacaacaaggaaaacaucccgguggacgagcuggccaacaacaucaucaacuuguucacguucaccucccugggcgcccccgccgcuuuuaaguucuucgacaagaucguggaccggaagcgcuacaccuccaccaaggaaguccugaacuccacgcucauccaccagagcaucaccgggcuguacgagacccggaucgaccugggcaagcucggcgaggacuga

SEQ ID NO: 7830 - RNA, 4134 nt, Artificial Sequence; identical to SEQ ID NO: 2030
  Cas9 variant

SEQ ID NO: 7831 - RNA, 4137 nt, Artificial Sequence
  Cas9 variant
augaagaccuucgccgaggaguacgugauggacaaaagcaagcccuauggcaucgggcuggacaucggcaccaacuccgucggguucguggccacggacgcggagggccaccucauccgccugaaggggaagaccgugaucggcgccuaucuauucaacgccggcaucagcgccgccgagcggcgcggguuccggaccacccgccggcgccucucccgggucaaguggcgccugggccugcuccgggagaucuucgagacgcacuuccaggagagcaugggggagaacgaggacaacgacuucuuccuccgcuucaaguacuccaacaucagccccaaagacccccaguucuccaccgcgaagggccuguucaaugaccggaccgacaaggaguucuacgaccaguaccccacuaucuaccaccuucgccgggcccugaugacggaggaccaccaguuugacauccgcgagaucuacaucgccaugcaccacaucgugaaguaccgggggcacuuccugaaggaaggccgcgccaaagacuucaaggugggcgaccuccggcuguuagacaacuucaagaugaugaacgagcagaucgaggagaucaacccccucuggcaacugaagcugccgaccgacgacgcgagcaucaaguccaucaccgccauccuccuggacaacacccagagccagaacgaucgccagaaggccgucacgaaggucauccuggccacccucgugaaggccagugacaaggacaucaacgcggcccguaagcgcuucgucggggagcugagcaaggccauggugggccugaagaccaagcucugggugcuggccgacgucucccagaacggggacugggagaucaaguacgagaauuacgccgacuucgcggagaccaucggcagcggggaguccgauacgauccagagccucuucaacgagaucaacgaccucuacggggugaucacccuggccggcaucauccccaaggaggccgaguccuucagcgacgggauggugcggaaguacgagcaccaccgcaaaaaccuggagcuccugaaggucuacugcgccgagcaguccgacggcaagcgcgggcggcagauccgccagaccuacgacaaguacauagacggcguggacagcaagcaguucacccaggaggacuuuuacaaggcccucagcaaguucacggcgaaggacgaggccaccuccgagaacgccaagcucaucgcccaggagaucgccgugggcaccuucaugcccaagcugcggaccaaggcgaauggaacgaucccccaccagcugcaccaaaaggaguuggacgccaucaucgagaaccagaagaaguacuacccguggcugggcgaggucaaccccguggagagccaccgccgggcccugcccuacaaacuugacgagcugguguccuuccgcauccccuacuacgucgggccaauggugacccccaccaagggcgaccccgagaaguccaaguucgccuggauggugcggaaggagcccgggaccaucacgccguggaacuucgaccagaaggucgaccgcucagcgagcggcgaggccuucauccagcggaugaagaccaccgacaccuuccugaucggcgaggacgugcucccccagcagucccugcuguaccagaaguucgagguccucaacgagcugaacaagaucaugaucaacgggaagcccaucugccgcgagcaaaagcaacggcuguucaagcagcuguucaugcaguacaagacggugaccgugaagaagguccagcagaaccucaucgccaacggcgaggagagcgagaacgugcccaucaccgggcuguccgacccgcugcgcuucaacagcuccuucucgaccuacaucgacuauaaggacauccucggcacagccgccgugaacgauaacgcgaagcaguccgacaucgagcagaucaucgccuggagcaccaucuucgaggacgccgccaucuuccgggagaagcugaacgacaucaccuggcugaacgacgaccagcgcaacaagcucucucacaagcgguaccgcggguggggccggcacagccgcaagcugcuggccgggcucagagacggggagggccagaccaucauugagcgccuguggaacaccaacgacaacuuuaugcagauccagaacgacuccgagaucgcgcgccagaucacggaggccaacuccuccaagauggccaccgccgaggggacggacgagaucaucgacggcuucuacaccagccccgaaaacaagaaggcccugcgggagguaaugaagguggugaaggauauccagcgcgcgcaccacggccaggccccggccugggucuacaucgagagccccagagagaccccgcgccccgggcagcggaccgugucccgcgagcagcagcucaccgaccuguacgagggcgccgcgaaggagaucguggacgacgccguccugaacgagcucaaagacaaggucaaaagcaaggagaacuuuaccgacaagcuggugcuguacuuccuccagaacgggcacgacaucuacgccaacgacaguaucaacaucgacaaccugaacgccuacgacaucgaccacgugcugccccagucccucaucaaggacgacucccuggacaaccgggugcugacgacccacgaacgcaaccucaagaagucuaaccgguucgccaccgagcuguucgcggaccagcgcaagaagugggagaaguggcaccggcugggccucaucagcagccgcaagcugaagcaccugacaaugcagcccaacuccguggagaaauucgcccacggguucaucgcccggcagcucacggagacccgccagaucauccaccugaccgccaauguccugagcaaccucuaccaggaaaacgacaccaagaucgugaugaucaaggccggccugaacuccgaguuccggcgcacguuugacuucccgaagaaccggagcgugaacgacuaccaccacgcguucgacgccuuccugaccgccaagaucggccgcuaccuccuggcccgguaccccaagcuggagccauucuucgucuacgggaacuucgugaagaacccgaaggccaugaagcgccucaguagcuucgacuucaucgcgcaguuggccgccaagaccgacgacaccucccacaucgaccagcggagccugaagcagguccccguggugaacgaggagacgggcgagaucgugugggacaaggauaucgagcucgccgagcuggacaaaaccuacaacuacaagaccaugcuggugaagcgcgcgcagaccgagaauaaugcccagauguucaagcagacgguguucaaggcccgcgacaaccagaauaagacccucauccccgugaagaacgggcuguccaccgacgucuacggcgggcacucccagcaggccaucagcuaccugugcaucguguggguuggccagaagaagaaguaccgaguccucggcaucuccaccgcccacgcggggauccugaacaacuucgagaagaacuacggccgcuucgaggccaaaaagaagcugcaggagaucgugagcaacacgcucgacaacgccgaccggaacgacuucaagaucguggcccccaaggucuuguucgagcaggucguggaggacgauaacaugaaguucgggcugggcuccgccagcgacuaccgcaacgugcagcagcuguuccucucccggaagaaccaacuccuccuggcgaacaugaugaccgaccagauccacgaccaggaccuggugcaccucuucgacgagaucguggggcagaugaacgcccacuucccgaucuucgaccguggcggcuaucggagcuccuuaacccagagccgcgacaaguuccugaagcuccccuucaagaagaacgaggaccugaucaccaagcaggaggucauccggcgcauccuggacgggcuccaugccaacgccaaccggaaggaccugaaaaucaucggcuccaagggggacuucggccgccuggggacgaagaagaucuaccucagcaaggacgccaaguuaauauacaccuccccgaccugccuguucacccggacggugcccuugagcucccucuga

SEQ ID NO: 7832 - RNA, 4137 nt, Artificial Sequence
  Cas9 variant
augacaaacgagaaguacagcaucggccuggacaucgggacauccagcaucggcuucgccguggucaacgacaacaaucgcgucauccgagugaaggggaagaacgccaucggcguccgccucuucgacgaggggaaggcagccgccgaucgccgcuccuuucggacgacccgccggcgccugagucggcgccgguggcgccugaagcuccugcgggagaucuucgacgcauacaucacccccguggacgaggccuucuuuaucaggcugaaggaguccaacuuaagcccgaaggacagcaagaagcaguacucuggcgacauccuguucaacgaccggagugacaaggacuucuacgagaaguaccccaccaucuaccaccuccgcaacgcgcugaugacggagcaccgcaaguucgacguccgcgagaucuacuuggccauccaccacaucaugaaguuccggggccacuuucugaacgccacccccgccaacaacuucaaggucgggcgccucaaccuggaggagaaguuugaggagcugaaugacaucuaccagcgaguguuccccgaugaaucaaucgaguuccgcaccgacaaccucgagcagaucaaggaggugcugcuggacaacaagcguagccgggcggaccgccaacggacucucgucagcgacauauaccaguccagcgaggacaaggacaucgagaagcgcaacaaggccguggccacggaaauccugaaggccucccugggcaacaaggccaagcucaacgugaucaccaacgucgagguggacaaggaggcagccaaggaguggucaaucaccuucgacuccgagagcaucgacgacgaccuggccaagaucgaggggcagaugaccgacgacggccacgagaucaucgaggugcugcggucccucuacagcgggaucacguugagcgccaucgucccggagaaccacacccugucccagagcaugguagccaaauacgaccuccacaaagaccaccugaaacuuuucaagaagcucauuaacggcaugaccgacaccaagaaggcgaagaaccugcgcgccgccuacgacggcuacaucgacggggugaaggggaaaguccugccccaggaggacuucuacaagcagguccaaguaaacuuggacgacuccgccgaggccaaugagauccaaacguauaucgaccaggacaucuucaugcccaagcagcggaccaaggcgaacgggagcaucccccaccaacugcagcagcaagagcuggaccagaucaucgagaaccagaaggccuacuacccguggcucgccgagcugaaccccaaccccgacaagaagcgccagcagcuggccaaguacaaacucgacgagcuggugaccuuccgggugcccuacuacgugggcccgaugaucaccgccaaggaccagaagaaccaauccggcgccgaguucgccuggaugauccgcaaagagccaggaaacaucacuccguggaacuucgaccagaagguggaccggauggccaccgccaaccaguucaucaagcguaugaccaccacugacaccuaccugcucggcgaggacgugcugcccgcccagucgcugcucuaccagaaauucgagguccugaacgagcugaacaaaauccggaucgaccacaagccgauuuccaucgagcagaagcagcagaucuucaacgaccucuucaagcaguucaagaacguaaccaucaagcaccuccaggacuaccugguaagccaggggcaguacuccaagcgcccccugaucgaaggauuagccgacgagaagcgguucaacagcucccugaguacauacuccgaccuaugcgggaucuucggcgccaaguuagucgaggagaacgauaggcaagaggaccuagagaagaucaucgaguggagcacgaucuucgaagacaagaagaucuaccgggccaagcugaacgaccucaccuggcugaccgacgaccagaaggagaagcuggccaccaaacgcuaucagggcugggggcggcucucccguaagcuguuggugggacucaagaacagcgagcaccgcaacaucauggauauccuguggaucacgaacgagaacuuuaugcagauccaggcggagcccgacuucgcaaagcuggugaccgacgccaacaaggggaugcucgagaagaccgacucccaggacgucaucaacgaccuguacaccagcccccagaacaaaaaggccauccggcagauccugcugguggugcacgacauccagaacgccaugcacggccaggcgccggccaagauccacgucgaguucgcccgcggggaggaacggaauccacgccggagcgugcagcgccagcgccaaguggaggccgccuacgagaaggucagcaacgagcuggugagcgcgaaggugcggcaagaguucaaggaggccaucaacaacaagcgggacuuuaaggaccgccugcuccuguacuucaugcaaggcggcaucgacauauauaccgggaagcagcugaacaucgaccagcucuccaguuaucagaucgaccacauccugccccaagccuucgucaaggacgacucccugaccaaccgagugcucaccaacgagaaccaggugaaggccgacagcgugcccaucgacaucuucggcaagaagaugcugagcguaugggggcgcaugaaggaccagggccugaucagcaaggggaaguaccggaaccucaccaugaacccggagaacauauccgcgcacacugagaacggcuucaucaaccgccagcugguggagacgagacaggucaucaagcuagccgugaacauccucgccgaugaguauggcgacagcacccagaucaucuccgugaaggccgaccugagccaccagaugcgcgaggacuuugagcugcucaagaaccgggacgucaacgacuaccaccacgccuucgacgcguaccuggccgccuucaucgggaacuaccugcucaagcgcuaccccaagcuggaguccuacuucguguacggcgacuucaagaaguucacccagaaggagaccaagaugcggcgcuucaacuucaucuacgaccugaagcacugcgaucagguggucaacaaggagacgggggagauccucuggacaaaagacgaggacaucaaguacauccgacaccuauucgccuacaagaagauccuggugagccacgaggugcgcgagaagaggggcgccuuguacaaccagaccaucuacaaggcgaaggacgacaagggcuccgggcagggcagcaagaagcugauccguaucaaggacgacaaggagaccaagaucuacgggggcuacuccggcaagagcuuggccuacaugacgaucguccagaucaccaagaagaacaagguguccuaccgcgugaucgggauccccacccuagcgcuggcccggcugaauaagcucgagaacgauagcaccgagaacaacggcgagcuguacaaaaucaucaagccccaguucacgcacuacaaggucgacaagaagaacggggagaucaucgaaacgaccgacgacuuuaagaucguggugagcaagguuagauuucagcagcugaucgacgacgccggccaguucuucaugcucgcguccgacaccuacaagaacaacgcccagcagcuggugauuagcaacaacgcccugaaggccaucaacaacacgaacaucaccgacugcccccgggacgaccucgagcgccuggacaaccugcggcucgacuccgcguucgacgagaucgugaagaaaauggacaaguacuucagcgcauacgacgccaacaacuuccgcgagaagauccgaaauuccaaccuuaucuucuaccagcugcccgucgaggaccagugggagaacaacaagaucaccgagcucgggaagcgcaccgugcucacgcggauucugcagggccuccacgccaacgccaccaccaccgacaugagcaucuucaagaucaagacgcccuucggucagcugcgccagcgguccggcaucagccuguccgagaaugcgcagcuaaucuaccagagcccgaccggccuguucgagcgccgggugcagcugaacaagaucaaguga

SEQ ID NO: 7833 - RNA, 4137 nt, Artificial Sequence
  Cas9 variant
augaagaacaaggacuacagcaucgggcuggacaucgggacuuccagcaucggcuucgccguggucgacgagaauaaccacgugaugcgcgugaaggggaagaacgccaucggcguccggcuguucgacgaggggaagcccgcggccgauagacgggcguuccgcacaacgcggcgccggcugucacgccggcgcuggcggcugaagcuccugcgcgagaucuucgacucauacauaaccccgguggacgaggccuucuucauccggcuuaaggaguccaaccucagccccaaggacucaaagaagcaguacagcggcgacauccuauucaacgaucgcuccgacaaagacuucuacaccaaguaccccaccauauaccaccuucguaaugcccucaugacggagcaccagcgcuucgacaucagagagaucuaccuggcgauccaccacaucgugaaauuccgcggccauuucuuaaacgccacccccgccaacaacuuucagguagggaagcucgaucuggaccagaaguucgaggacuugaacgacaucuaccagcggguguucccggacgacagcaucgaguuccgcaucgacaaccucgagcagaucaaagccgugcugcuggacuccaagcggagcagauccgacagacagcggagccucgucgacgacguguaccagaccuccgaggacaaggagguggagaagcagaacaaggcggucgccaccgagguguugaaggccauacugggaaacaaggccaaguugaauaucaucgcaaacguggaggucgacaaggaggcggccaaggaguggacgaucaccuucgacagcgaguccaucgacgacgaccuggccaagaucgacgggcagaugaccgacgacggccgcgccauaguggagauccugcggagccucuauuccgggauuacccugagcgcuauugugccagagaaccauacgcugagccaggcgauggucgccaaguacgaccuccacaagaagcaccugacccugcucaagaagcugaucaacagcaugaccgauacgaaaaaggccaagaaccugcgcgccgccuacgacggcuacguggacggcgugaaggggaagguccucacgcaggacgaguucuauaagcagauccaaagcaaccucgacgaguccguggaggcgagcgagauucagaccuacaucgaccaggacaucuucaugcccaagcagcggaccaaggccaauggcuccaucccccaccagcugcagcagcaggaacucgaccagaucaucgagaaccagaaggaguacuacccguggcuggccgagcugaacccuaaccccgacaagaagcgccaacagcucgccaaguacaagcuggacgagcuggugaccuuccggguccccuauuacgugggcccgaugaucaccgccgaggcgcagaagaagcagucuggcgccgaguucgccuggaugauccggaaggaguccggcaacaucacccccuggaacuucgaccagaagguugaucggauggccaccgcgaaccaguucaucaagcgcaugaccacgaccgauacguaccuucugggggaggacguccugcccagccagucccuccuguaccagcgguucgaggugcugaacgagcucaacaaaauccgcaucgaccggaagcccaucucgguagagcugaagcagcagaucuucaacgaccuguucaagaaguucaagaacguuaccaucaagcaccuccaggacuaccucguggcccagggccaguacuccaagcgcccgcugaucgaggggcuggccgacgagaagcgguucaacagcggccucuccacauacaacgacuucuguggaaucuucggcgcaaagcuggucgacgaaaacgaccgccaggccgaccuggagaagaucaucgaguggagcacuaucuuugaagacaagaagauauaccgggcgaagcucaacgaccuggccuggcugaccgacgagcagaaggacaagcucgccaccaagcgcuaucaaggcugggggcggcuguccagcaagcugcucaucggcuuacagaacuccgagcacagaaacaucauggaucuacuauggaucgggaacgagaacuucaugcaaauccaggccgacuccgacuucgccaagcugaucaaggacgcgaaccagaacgcccugcagaacaaugacucccaggacgugaucaacgaccucuacaccagcccccagaacaagaaggccauccgccagauacugcuggugguccaugacauccagaacgcuaugcacggccaggcccccaccaaaauccacguggaguucgcgaagggggaggagcggaacccccgccggagcgugcagcgccagcggcaggucgaggccgccuacgagaaggccuccaacgagcucgucggcgccaacgugcgcgaggagcugaaggacgccaucaccaacaagcgggacuucaaagaccgccuguuccucuacuucaugcaaggcggggucgacauguacagcggggagccgauuaacauugacaaccugucccgguacgacaucgaccacauccugccucaggccuucguaaaggacgacagccucaacaaccgcgugcugaccgacgccgagaagaaucggcgcaaaucugacgccguucccaacgagcuguucggggcgaagaugcgggugacgugggagcgcaugaaggagcagggucucaucagcaaggggaaauaucgaaaccugaccaugaaccccgagaacaucaacaaguacaccgagaacggguucaucaaccggcagcugguggagaccagacaggucaucaagcucgccgugaacauccuggcugaugaguacaaggagaacacucagaucaucuccgugaaggccgaccugagccaccagaugcgcgaggacuucgagcuccugaagaaccgggacgucaacgacuaccaccacgccuucgacgcuuaccuggccgccuucaugggcaacuaccuccugaagcgcuacccgaagcugcgguccuacuucguguacggggauuucaagaaguucacgcagaaagagaucaagcuccgacgcuuuaacuucaucuacgaccugaaacacgaggaccaggugaucgauaaggagaccggcgagaucuuauggaacaagaacgaggacaucgccuacauccggcaccucuucgccuacaagaagauccugaucagccacgaggucuccgagcgccgcggagcgcuguacaaccagaccguguacaaggccuccgacgacaaggccuccggccaaggcagcaagaaacucauccccaucaaauccgacaaacccaccgagaucuacgggggcuacacgggacggacccuggccuacaugaccaucgugaaggucaccaagggcaagaagaucagcuacaaggugguggggguccccacggcaguccuggccaagauggcgggcgugcggcagggcucccaggaggagcaggacaagcucuacgggguccugaagccgcaguucacccaccagaaggagaacaagaagaccggcgagaucaccgagacgguggacaaguuugacaucaucgugcccaaggucaaguaccagcaacuggugaacgacaacggucagcuguucaugaucggcagugacacccugcccuacaacgccgagcagcuggugcucagcaaggaguccguccagaccauuaacaauccugggaucaaagacgagggcagcgacgaggaguccgagaacaagaagcuggacaacguguaugacgagaucgugcuguguaugaacaaguauuuuccccucuacgacaaccgcgguuuccgcaacagcaucaccaacgggaagaacaaguuccugaagcugccuaucaagaacaucuauaagaacggcaagcucaucaacgucgggaagcgugaggugaucaaccgcauccuucagggccugcacgccaacgcguccgugacggaccucagcaaccuagggaucaagucccccuucggcuuccugcagaagggcgcggggcucagccuuucuggggaggcccagcucauccaccaaagcgccaccggccucuucgagcaccgaguccaguuaaacaagaucaaguga

SEQ ID NO: 7834 - RNA, 4137 nt, Artificial Sequence
  Cas9 variant
augagcaacaagcccuacuccaucggccuagauaucgggaccaacagcgucggcugggccgucaucaccgacgauuacaaggugccguccaagaaaaugaaagugcucgggaacacugacaagcacuucaucaagaagaaccugaucggcgcccugcuguucgacgaggggaccaccgcggagggccgccggcugaagcgcaccgcgcggagacgguacacgcgccggaagaaccgccugcgguaccuccaggagaucuucagcgaggagaucuccaaggucgacagcuccuucuuccaccgccuggacgacucguuccuggugcccgaggacaagcggggcuccaaguaccccaucuucgcgacccucgccgaggagaaggaguaccacaagaacuuccccaccaucuaccaccuccgcaagcagcuggccgacagcaaggagaaagcggacuuacggcugaucuaccuggcccucgcgcacaugaugaaguacagagggcacuuccuguacgaggaguccuucgacaucaagaacaacgacauccagaagaucuucaacgaguucaucagcaucuacgacaacaccuucgagggcuccagccuguccgagcagaacgugcaggucgaggccaucuucacggacaagaucagcaaguccgcgaagcgggagcgcgugcucaagcuguucccggacgagaaguccaccgggcuguucagcgaguuccucaagcugaucgugggcaaccaggccgaguucaagaagcacuucgaccucgaggagaaggcgccccuccaguucagcaaggacaccuacgacgaggaccuggagaaccugcucgggcagaucggcgacggcuucgcggaccuguuucuggucgccaagaagcucuacgacgccauccugcugagcgggauccucaccgugacggaccccuccaccaaggcgccccugagcgcguccaugaucgagcgguacgagaaccaccagaaggaccuggccagccucaagcaguucaucaagaauaaccugccggccgagaagugcguggaggucuucucugaccagagcaaggacggcuacgccggguauaucgacggcaagaccacccaggaggccuucuacaaauacaucaagaaccuacucuccaagcuggagggcgccuacuacuuccuggacaagaucgagcgcgaggacuuccuccggaagcagcgcaccuucgacaacgggagcaucccccaccagauccaccuccaagagaugaacgccaucuuacggcgccagggcgagcacuaccccuuccugaaggagaaccgcgagaagaucgagaagauccuaaccuuccggauccccuaccacguggggccacuggcccgcggcaaccgggacuucgcgugguuaacccgcaacuccgacgaggccauccggcccuggaacuucgaggaaaucguggaccaggccagcuccgccgaggacuucaucaacaagaugaccaacuacgaccuguaccugcccgaggagaagguccugcccaagcacagccuccuguacgagacguucgccguguacaacgagcugaccaaggugaaguucaucgcagaggggcucaccagguaccaguuccuggacaagaagcaaaagaaggacaucuucuacaccuucuuuaaggccgaggacaagcggaaggucacggagaaggacauuauccacuaccugcacaacguggauggauacgacggcaucgagcucaaggggaucgaaaagcaguucaacgccucccugagcacauaccacgaccugcucaagauaaucaaggacaaggaguucauggacgacccgaagaacgaggagauccuggagaacauugugcacacccugaccauauucgaggaccgcgagaugaucaagcagcggcucgcccaguacgacucccuguucgaugagaaggucaucaaggcgcugacgcgucggcacuacacgggcugggggaagcucagcgcuaagcugaucaacggcaucugcgacaagcagaccgggaagaccauccuggacuaccucaucgacgacggcaagaucaaccgcaacuucaugcaguugaucaacgacgacggccuguccuucaaagaaaucauccagaaggcccagguggucgggaagacguacgacgucaagcaggucgugcaggagcuccccggcagccccgccaucaagaaggggauccugcaguccgugaagcugguggacgagcucgucaaggugaugggccacgcccccgagagcaucgugaucgagauggcacgggagaaccagaccacggccaaggguaagaagaacagccagcagcgcuacaagcggaucgaggacgccauaaagaaccuggccccgggccuggacuccaccauccucaaggagcaccccacggacaacauccagcugcagaacgaccgccuguuccucuacuaccugcaaaacggccgggacauguacaccgggaagccccuggagaucaaccagcucagcaacuacgacaucgaccacaucaucccccaggccuucaucaaggacgacucccuggacaaccgcguccugaccagcuccaaggagaaccggggcaagagcgacaacgugccgucccucgagguggucgagaagaugaaggcguucuggcagcagcugcuggacagcaagcucaucuccgagcgcaaguucaacaaccucaccaaggccgagcgcgggggccuggacgaacucgacaaggugggcuucaucaagcggcagcugguggagacccgccagauuacgaagcacgucgcccagauccuggacgcccgguucaacaaggaggugaccgagaagaacaagaagaaccgcaacgugaagaucaucacccucaagucgaacauggucuccaacuuccggaaggaguucgggcuguacaaggugcgcgagaucaacgacuaccaccacgcccacgacgcguaccugaacgccguggucgccaaggccauccucaagaaguaccccaagcuggagcccgaguucguguacggcgacuaccagaaguacgaccugaagcgguacauuagcaaguccaaggaccccaaggagguggagaaggcgaccgagaaguacuucuucuacagcaaccuccugaacuucuucaaggaggagguccacuacgcagacgguacgaucgugaagcgcgagaacaucgaguacuccaaggacaccggcgagaucgccuggaauaaggagaaggacuucgccaccaucaagaaggugcucagcuucccgcaggucaacaucgugaagaaaaccgaggagcaaacgguggggcagaacggcggccucuucgacaacaacaucgucuccaaggagaaggugguggacgccagcaagcugauccccaucaagagcgggcugucccccgagaaguacggcggguacgcgcggccgaccaucgccuacagcguccucgugaccuacaagcagaacaacaagaucaagaacaccauggugggcauacccguccugacgaagcuggaguucgaacgcgaccccaaccucuaccugcggaaccuggggaucaacaacgugucccacgugaucaagcucgucaagcacaccguguuggaguucaaacacaaauacggcaccuaccgccgguucaucgugagcaaccaggagcugaagcgcgccaaccagaucuucgucaccacgaagcagaugaagcucaucucccaguacaccacccuggacaagaacgagcacgacagccugcucaagaacaaccagcagcugauccaguccaucuggaaccaguuccuggaguucaugcucgccaccgaccuggugaacaagaagcaguacgacgagcugauccucacgaacaaccagacgaucgaggagugccggaacaucaugaaccgcgugaucaccacccugagcuucacgaacaucaacgccggccagaagaagaucaucuucgacgauacccugucccuccccaucaagcgguggcaguucaccgauagcgacaagauggucaagaagaucaucgaguccacccugauccaccagagcaucacggggcuguacgagacccgcaucgaccucaacaagcugggcgaggacuga

SEQ ID NO: 7835 - RNA, 4137 nt, Artificial Sequence
  Cas9 variant
augaacaagcccuacagcauuggccucgacaucggcaccaacuccgugggcuggagcaucaucaccgacgacuacaagguaccggccaagaagaugcgcgugcucgggaacacggacaaagaguacaucaagaagaaccugaucggcgcccugcuguucgacgggggcaacaccgcggccgacagacgccugaagcggaccgcccgccggcgcuacacccggcgccgcaaccgcauccuguaccuccaggagaucuucgccgaggagaugaguaagguggacgacagcuucuuccaccggcuggaggacaguuuccuggucgaggaggacaagagaggcagcaaguaccccaucuucgccacgaugcaggaggagaaguacuaccacgagaaguuccccaccaucuaccaccuccggaaggagcuggcggacaagaaagagaaggccgaccugcgccucaucuaccuggcccuggcccacaucaucaaguuccgggggcacuuccucaucgaggacgaccgauucgacgugcgaaacaccgacauucagaagcaguaccaggcguuccuggagaucuucgacaccacguucgagaacaacgaccugcucucccagaacguggacgucgaggccauccugaccgacaagaucagcaagagcgccaagaaggaccgcauccuggcccgguaccccaaccagaaguccaccggcaucuucgccgaguuccucaagcugaucguggggaaccaggcggacuucaagaagcacuucaaccuggaggauaagaccccgcuccaguucgccaaggacagcuacgacgaagaccuggagaaucugcucggccagaucggggacgaguucgccgaccuguucagcgccgccaagaagcuguacgacuccguucuccugagcggcauccugacggucaucgaccucuccaccaaggcgccccugagcgccuccaugauccagcgcuacgacgagcaccacgaggaccugaaacaccucaagcaguucguuaaggccagccugcccgagaacuaccgggagguguucgccgacuccagcaaggacggcuacgccggguacaucgagggcaagaccagccaggaggcguucuacaaguaccugcucaagcugcugaccaagcaggagggguccgaguaccuccuggagaagaucaaaaacgaagacuuccugcgcaagcaacgcacguucgacaacggcagcaucccccaccagguccaccucaccgagcugcgggccauaauccgccggcaguccgaguacuacccguuucugaaggagaaccucgaccgcaucgagaagauccugaccuuccggauccccuacuacgugggcccgcucgcccgcgagaaguccgacuucgcuuggaugacccggaagacggacgacagcauucgccccuggaacuucgaggaccugguggacaaggagaaguccgccgaggcguucauccaccgaaugaccaacaacgaccucuaccugccggaggagaaaguccugcccaagcacagccucaucuacgagaaauucaccguguacaaugagcugaccaaggugcgcuuccuggccgagggguucaaggacuuccaguuccucaacaggaagcagaaggagacgaucuucaacagccuguucaaggagaagagaaaggucaccgagaaggacaucaucucauuccugaacaagguggacggcuacgaggggaucgcuaucaagggcaucgagaagcaguucaacgccagccucuccacauaccacgaccugaaaaagaucuuggggaaggacuuccucgacaacaccgacaaugagcugauccuggaggacaucauucagacgcucacccuguucgaggaccgggagaugaucaagaagcgccuggacaucuacaaggacuucuucaccgagagccagcucaagaagcuguaccggcgccacuacaccggcuggggccggcuguccgcuaagcucaucaacgggauccgcaacaaggagaaccagaagacgauccuggacuaccugaucgacgacggcagcgccaaucggaacuucaugcagcucaucaaggacgccgggcuguccuucaagcccaucaucgacaaggcccgcaccggcagccacuccgacaaccuaaaggagguggucggggagcucgccggcagccccgcgaucaagaagggcaucuugcagucccugaagaucguggacgagcucgugaaggugaugggguacgagccggagcagaucguggucgagauggcccgcgagaaccagaccaccgccaagggucugagccggagccgccagcggcugacuacccuccgcgagucccuggguaaccucaagucgaacauccucgaggagaagaagcccaaguacgugaaggaccagguagagaaccaccaccuguccgacgaccggcuguuccucuacuaccugcagaacggcaaggacauguacaccgaugacgagcuggacaucgacaaccucagccaguacgacaucgaccacaucaucccacaggccuucaucaaggacgacuccaucgacaaccgcguccuugugagcuccgccaagaaccggggcaagagcgacgacgugcccuccaucgagaucgucaaggcgcggaaaauguucuggaagaaccugcucgacgccaagcugaugagccagcgcaaguacgacaaccugaccaaggccgagcgcgggggccucaccuccgacgacaaggcgcgguucauccagcgccagcugguggagacgcggcagaucaccaagcacguggcccgcauccuggacgagcgguucaacaacgaguuagacagcaaggggcgccggauccgcaaggucaagaucgugacccugaaguccaacuuagugagcaacuuccggaaggaguucggcuucuauaaaauccgcgaggucaacaacuaccaccacgcgcacgacgccuaccucaacgccgugguggccaaggcgauccugaccaaauacccgcagcuggagcccgaguucgucuacgggcucuaccggcgcaagaagcuguccaagaucgugcgcgaggacaaggaggagaaguacagcgaggccacgcggaagauguucuucuacuccaaccugaugaacauguucaagcgcgugguccggcucgccgauggcagcaucgugguucgccccgucaucgagaccggccgguacauggggaagacagccugggacaagaagaagcacuucgccaccgugcgcaaggugcugagcuacccccagaacaacaucgucaagaagacggagauccagaccggcggguucuccaaggagagcauccuggcgcacggcaacuccgacaagcucaucccgcggaaaaccaaggacaucuaccuggaccccaagaaguacgggggcuucgacagcccgaucguggccuacuccgugcuggucguggccgacaucaagaaggguaaggcccaaaagcucaagacagugacagagcugcuggggaucaccaucauggagcgcagccgguucgaaaagaacaccuccgccuuccucgagagcaagggcuaccugaacauccgcgacgacaagcugaugauccuccccaaguacucccuguucgagcuggagaacgggcggcgccggcuccuggcgagcgccggcgagcuucagaaggggaacgagcucgcccugccgacccaguucaugaaguuccuguacuuagcgucccgcuacaacgagagcaagggcaagcccgaggagaucgagaaaaagcaggaguucguaaaccagcacguguccuacuucgacgacauccugcagcugaucaacgacuucagcaaccgcguaauacucgccgacgcgaaccuggagaagaucaacaagcuguaccaggacaacaaggagaacauccccgucgacgagcucgccaacaacaucaucaaucuguucacguucaccucccugggcgccccggccgcguucaaguucuucgacaagaucguggaucgcaagcgauacaccagcaccaaggaagugcucaacuccacguuaauccaccagagcaucaccgggcuguacgagacccgcaucgaccucggcaagcugggggaaggcuga

SEQ ID NO: 7836 - RNA, 4137 nt, Artificial Sequence
  Cas9 variant
augaccaacgagaaguacagcaucggccuggacaucgggaccuccagcaucggcuucgccguggucaacgacaacaaccgcgugauucgggugaaggggaagaacgccauaggcguccgccucuucgacgaggggaaggcggccgccgaccggcgcuccuucaggacgacccgccggcgccugagccggcgccgguggcgccugaagcuccugcgugagaucuucgacgcguacaucaccccgguggacgaggccuucuucauccgccugaaggaguccaaccucagcccgaaggacuccaagaagcaguacagcggcgacauccuguucaaugaccgguccgacaaggacuucuacgagaaguaccccaccaucuaccaccuccgcaacgcgcugaugacggaacaccggaaguucgacgugcgcgagaucuacuuagccauucaccacaucaugaaguuccggggccauuuccucaacgccacccccgccaacaacuucaaggucgggcgccucaaccuggaggagaaguucgaggagcugaacgauaucuaccagcggguguucccggacgagagcaucgaguuccgcaccgacaaccucgaacagaucaaggaggugcugcuggacaacaagcgcucccgggcggaccgccagcggacccucgucagcgacaucuaccaguccagcgaggacaaggacaucgagaagcgcaacaaggccguggccacggagauccugaaggcgucccuggggaacaaggccaagcucaacgugaucaccaacgucgagguggacaaggaggcggccaaggaguggagcaucaccuucgacuccgagagcaucgacgacgaccuggccaagaucgaggggcagaugaccgacgacggccacgagaucaucgagguccugcggucccucuacagcgggaucacgcugagcgccaucgucccggagaaccacacccugucccagagcaugguggccaaguacgaccuccacaaggaccaccugaagcuguucaagaagcucaucaacggcaugaccgacaccaagaaggcgaagaaccugcgcgccgccuacgacggcuacaucgacggggugaagggcaagguccugccccaggaggacuuuuacaagcagguccaggugaaccucgacgacuccgccgaggccaacgagauccagacguacaucgaccaggacaucuucaugcccaagcagcggaccaaggcuaacggaagcaucccccaccagcugcagcagcaggagcuggaccagaucaucgagaaccagaaggccuacuacccguggcucgccgagcugaaccccaaccccgacaagaagcgccagcagcuggccaaguacaagcucgacgaacuggugaccuuccggguccccuacuacgugggcccgaugaucaccgccaaagaccagaaaaaccaguccggcgcggaguucgccuggaugauccgcaaggagcccgggaacaucacgcccuggaauuucgaccagaagguggaccggauggccaccgccaaccaguucaucaagcgcaugacuaccacggacaccuaccugcucggcgaggacguacugcccgcgcagucccugcucuaccagaaguucgagguccugaaugaacugaacaagauccggaucgaccacaagccgaucuccaucgagcagaagcagcagaucuucaacgauuuauucaagcaguucaaaaacgugaccaucaagcaccuccaggacuaccuggugagccaggggcaguacuccaagcgcccccugaucgagggccuggccgacgagaagcgguucaacagcucccugucaaccuacuccgaccugugcgggaucuucggcgcgaagcucgucgaggagaacgaccgccaggaggaccuggagaagaucaucgaguggucaacgaucuucgaggacaagaagaucuaccgggccaagcugaacgaccucaccuggcugaccgaugaccagaaggagaagcuggcaaccaagcgcuaccagggcugggggcggcucagucgcaagcugcuggugggccucaagaacagcgagcaccgcaacaucauggacauccuguggaucacgaacgagaacuucaugcagauccaggcggaacccgacuucgccaagcuggugaccgacgccaacaaggggaugcucgagaagaccgacucccaagacguaaucaacgaccuguacaccagcccccagaacaagaaggcuauccggcagauccuacucguggugcacgacauucagaacgccaugcacggccaggcgccggccaagauccacgucgaauuugcccgcggggaggagcggaacccccgccgguccgugcagcgccagcgccaaguggaggccgccuacgagaaggucagcaacgagcuggugagcgcgaaggugcggcaggaguucaaggaggccaucaacaacaagcgggacuucaaggaccgccuguuccucuacuucaugcagggcggcaucgacaucuacacggggaagcagcugaacauugaccagcuguccagcuaccagaucgaccacauccucccccaggccuucguuaaggacgacagucugaccaaccgggugcugaccaacgagaaccaggugaaggccgacagcguccccaucgacaucuucggcaagaagauguuauccgugugggggcgcaugaaggaccagggccugaucagcaaggggaaguaccggaaucugaccaugaacccggaaaacaucuccgcgcacaccgagaacggcuucaucaaccgccagcucgucgagacgcggcaggucaucaagcuggccgugaacauccuggccgacgaguacggcgacagcacccagaucaucuccgugaaggccgaccucagccaccagaugcgcgaagacuucgagcugcugaagaaccgggaugucaacgacuaccaccacgccuucgacgcguaccucgccgccuucauagggaacuaccugcugaagcgcuaccccaagcucgaguccuacuucguguacggcgacuucaagaaauucacccagaaggagaccaagaugcggcgcuucaacuucauauacgaccuaaagcacugcgaccagguggucaacaaggagacgggggagauccuguggacgaaggacgaggacaucaaguacauccggcacagcuucgccuacaagaagauccucgugucccacgagguucgcgagaagcgcggcgcccuguacaaccagaccaucuacaaggcgaaggacgacaagggaagcgggcagggguccaaaaagcugauccggaucaaggacgacaaggagaccaagaucuacgggggcuacagcgggaagucccucgccuacaugacgauaguccagaucaccaaaaagaacaaggugagcuaccgcguaaucggcauccccacccuggcccucgcccggcucaacaagcuggagaaugacagcaccgagaauaacggggagcuguacaagaucaucaagccccaguucacccacuacaaggucgacaagaagaacggggagaucaucgagacuaccgacgauuucaagaucgugguguccaagguccgcuuccagcagcucaucgacgacgcuggccaguucuucaugcuggcgagcgacaccuacaagaacaacgcccagcagcuggugaucuccaacaacgcccucaaggccaucaacaacacgaacaucacggacugcccgcgggacgaccuggagcgccuugacaaccuccggcuggacagcgcguucgacgagaucgugaaaaagauggacaaguacuucuccgccuacgacgcuaacaacuuccgcgaaaagauccggaauagcaaccugaucuucuaccagcuccccgucgaggaccagugggagaauaacaagaucaccgagcuggggaagcgcaccguacugacccggauacuccagggccugcacgccaacgcgaccacaaccgacauguccaucuucaagaucaagacgcccuucgggcagcugcgccagcggagcggcaucucccuaagcgagaacgcgcagcugaucuaccagagcccgaccggccuguucgagcgccgggugcagcucaacaagaucaaguga

SEQ ID NO: 7837 - RNA, 4137 nt, Artificial Sequence
  Cas9 variant
augaccaacgaaaaguacagcaucggccuggacaucgggaccaguagcaucggcuucgccgucgucaacgacaacaaccgcgugauccgggugaaggggaagaacgcaaucggcguccgccucuucgacgaggggaaggcggccgccgaucggcgcaguuuccggacgacccgccggcgccugagccggcgccgguggcggcugaagcuccugcgggagaucuucgacgccuacaucacccccguggacgaggccuucuucauacgccugaaggaguccaaccucagcccgaaggacuccaagaagcaguacagcggcgacauccucuucaacgaccgguccgacaaggacuucuacgagaaguaucccaccauauaccaccuccgcaacgcgcucaugacugagcaccggaaauucgaugugcgcgagaucuaccuggcuauacaucacauuaugaaguuccggggccacuuucugaacgccaccccugccaacaauuucaaggucgggcgccucaaccuggaggagaaguucgaggagcugaacgauaucuaccagcggguguuccccgacgagagcauugaguuccgcaccgacaaccucgagcagauuaaggaggugcugcuggacaacaaacgcucccgggcggaccgccagcggacuuuagucagcgacaucuaccaguccagcgaggacaaggacaucgagaagcgcaacaaggccguggccacagagauccugaaggccucccuggggaacaaggccaaacucaaugugaucaccaacgucgaggucgacaaggaggcggccaaggaguggagcaucaccuucgacuccgagagcaucgacgacgaccuggccaagaucgagggucagaugaccgacgacggccacgagauaaucgaggugcugcggucccucuacagcgggaucacgcugagcgccaucgucccggagaaccacaccuuaucccagagcaugguggccaaguacgaccuccacaaggaccaccugaagcuguucaagaagcucaucaauggcaugaccgacaccaaaaaggcaaagaaccugcgcgccgccuacgacgguuauaucgacggggugaagggcaagguccugccccaggaggacuuuuacaagcaaguccaggugaaccucgacgacuccgccgaggcgaacgagauccaaacuuacaucgaccaggacaucuuuaugccuaagcagcggaccaaggcgaacgggagcaucccccaccagcugcaacagcaggagcuggaccagauuaucgagaaucagaaggccuacuacccguggcucgccgaacugaaccccaaccccgacaagaagcgccagcagcuggccaaguacaagcucgacgagcuggugaccuucagagugcccuacuacgucggcccgaugaucaccgccaaggaccagaagaaccagucuggugcugaguucgccuggaugauccgcaaggagcccgggaacaucacgcccuggaacuucgaccagaaggucgaccggauggccaccgccaaccaguucaucaaacgcaugaccaccacggacaccuaucugcuuggcgaggacgugcugccagcgcagagccugcucuaccagaaguucgagguucucaacgagcugaacaaaauccggaucgaucacaagccgaucuccauagagcagaagcagcagaucuucaacgaccucuuuaagcaguucaagaacgugacuaucaaacaucugcaagacuaccuggugagccaggggcaguacuccaagcgcccccugaucgagggccuggccgacgagaagcgauucaacucuucccugagcaccuacuccgaccugugugggaucuucggcgcgaagcucgucgaggaaaacgaccgccaggaggaucuugagaagauuaucgaguggagcacgaucuucgaagacaagaagaucuaccgggccaaacugaacgaccucaccuggcugaccgacgaccagaaggagaagcuggccaccaagcgcuaccagggcugggggcggcucucccgcaagcugcuggugggauuaaagaacagcgagcaccgcaacaucauggacauacuguggaucacaaacgagaacuucaugcagauccaggcggagcccgacuucgcgaagcuggugaccgacgccaacaaggggaugcucgagaagaccgacucccaggacgucaucaacgaccuguacaccagcccccagaacaagaaggccaucagacagauacugcucguggugcaugacauccagaacgccaugcacggccaggcgccugccaagauccacguagaguucgcgcgcggggaggagcggaacccccgccgguccgugcagcgccagcgccagguggaggccgccuacgagaaggucagcaacgagcuggugagcgcgaaggugagacaggaguucaaggaagccaucaacaauaaacgggacuucaaggaccgccuguuccucuacuucaugcagggcggcaucgacaucuacacggggaagcagcugaacaucgaccagcuguccagcuaccagaucgaccacauccucccccaggccuucgucaaggacgacucccugaccaaccgggugcugaccaacgagaaccaggugaaggccgacagcguccccaucgacaucuucggcaaaaagaugcuauccgugugggggcgcaugaaggaccagggccugaucagcaaggggaaguaccgaaaccugaccaugaauccggagaacaucuccgcgcacaccgagaacggauucaucaaccgccagcucguggagacgcggcaggucaucaaguuagccgugaacauccuggccgacgaguacggcgacagcacccagaucaucuccgugaaagccgaccucagccaccagaugcgcgaggacuucgagcugcuuaagaaccgagacgucaaugacuaccaucaugccuucgacgcguaccucgccgccuucaucgggaacuaccugcugaagcgcuaccccaagcucgaguccuacuucguguacggggacuuuaagaaguucacccagaaggagaccaagaugcggcgcuucaauuucaucuacgaucugaagcacugcgaccagguggucaacaaggagacgggggaaauccuguggaccaaggacgaggacaucaaguacauccggcaccucuucgccuacaagaagauccuggugagccacgaggugcgcgagaagcgcggcgcccuguacaaccagaccaucuacaaggcgaaggaugacaaggguuccgggcagggaagcaagaagcucauccggauaaaagacgacaaggagaccaagaucuacgggggcuacuccggcaagagccuggccuacaugacgaucguccagaucaccaagaagaacaagguguccuaccgcgugaucgggauccccacucuagcccuagcccggcugaacaagcuggagaacgacagcaccgagaacaacggcgagcucuacaaaaucaucaagccccaguucacgcacuacaagguggacaagaagaacggggagaucauugagaccaccgacgacuucaagaucgugguuaguaagguucgcuuccagcagcugaucgacgacgccggccaguucuucaugcucgcguccgacaccuacaagaacaacgcccagcagcucguaaucagcaacaacgcccugaaagccaucaacaacacgaacaucaccgacugcccgcgggacgaccuggagcgccuggacaaccugcggcuagacuccgcguucgacgagauugugaagaagauggacaaguacuucagcgccuacgacgcaaacaacuuccgcgagaagauccggaacuccaaccucaucuucuaccagcugccugucgaggaccagugggaaaacaacaagaucaccgagcucgggaaacggaccgugcucacgcggauccugcagggacugcacgccaacgccaccaccaccgacaugagcaucuucaagauuaagacgccauucgggcaacuccgccagcgguccggcaucagccuguccgagaacgcgcagcugauuuaccagagcccgaccggccucuucgagcgaagagugcagcugaacaagaucaaguga

SEQ ID NO: 7838 - RNA, 4140 nt, Artificial Sequence
  Cas9 variant
augaagcagauacugggccucgaccuggggacgaccucaaucggcugggcccuggugcgcgaggccgagaacaaggacgagcaguccagcaucguccggaucggggugcgcgugaauccccucacauccgacgagcagaagaacuucgagcagggcaagagcauaaccaccaacgcggaccggacacucaagcgcuccaugcggcgcaaccugcagcgguacaagcuccgccgggaccaccugaaggacugccuucagaagaacgggaucaucacggacaaggccguccucagcgagaacggcaacuacaccacguuccagaccuacuaccugcgcgccaaggccgugaacgagaagaucucccuggaggaguucgcacgggugcuccugaugcugaacaagaagcgcggcuacaagagcucccggaagaugaaguccgcggacgaggggcaacucaucgacggcaugagcgucgccaagcgccuguacaacgacaacauuacgccggggcaguacgugcugagccuucuggaggagggccggaaguacauccccgauuucuaccgcuccgaccugcucgacgagcuggacaaaaucuggaccuuccagcagugcuucuaccccgagauccugacccccgagugccggaagcucaucgccgggaagggcaagcaggccaccgcgaagaucuuccugggcaaguacaagauuuacacggccgacaacaagagcaaggacaagcgacugcaggccuaccaguggcggguggaggcgcucuccgggcagcugccgaucgaggucguggccuucguggucugcgagaucaacggcgcgauccaggccagcuccggguaccugggcgccaucagcgaccgcuccaaggagcucuacuucgagggccugaccguggggcaguaccuggugaagcagcucgagaagaaccccgacaccagccugaaaaacaaggucuucuaccggcaggacuaccugaacgaguucgaaaagaucugggagaagcaggccgaguaccacaccgagcucacaccccagcugaagaaggaggugcgcgacaucaucaucuucuaccagcgcacccucaagagccagaagggccuggugggguuuugcgaguucgagucccggcagaucgaggucaugaucgacggcaagcugaaaaagaagaccguggggugccgcgugugccccaagaguagcccgcuguuccaggaguacaagaucuggcacaaccuaaacaaccugaagaucgucgagaaggagcugggcaagagccgcuuccucaaccaggacgagaaggagucccuguuccaggagcugaacaucaaggaaaagcucagcaaaaccgacauccugaaacugcugugccucaaggccaaggaguucgaccugaacuucgagaagguggaggguaaccgcacgcaggcggagcuguuccgggcuuaccaggccaucaucgagauguccgggaacggcgacuacgauuucagcaagaugaccuccagcgagauccaggacaccgucaccggggucuuccgcggccucggguacaacacggacauccuguccuucgacgccgagaaggaggagaagaccuucgacaagcagcccauguaccugcucuggcaccuccuguacagcuacgagggcgacuccagcgacaccggcaacaaggcccugaucaccaagaucaagaagcugugcggguucgaguccgaggaguacgcgcggauccugacggacgugaccuuccagagcgaguacggcaaccucuccacuaaggccauccgccggauccugcccuucaugaagaaggggagcgaguacuccgaggccugccgccacgccggcuaccggcacagcgaacgcagccugaccaaggaggagcucgacaagaaggucuacaaggaccaccuggagcugcucccccggaacucccuucgcaacccggugguggagaagauccugaaccagaugauccaugucgugaacacgguggucgacaccuacgggaagcccgacgagauccggaucgagcucgcccgugagcugaagaaguccgcgaaggagcgagacgagaugaccgccagcauuaacaagaccgccgccgagcacaagaaguacugcgaagugcugcagaaggaguucggcuucacgcacgugagccgcaacgacaucauccgguauaagcucuaccuggagcuggagaacaacggcuacaagacccucuacuccgacaccuacaucccccgcgagaagcuguucagcaaggaguucgacaucgagcacaucaucccccaguccaagcuguucgacgacagcuucuccaacaagacccucgagugccgcagcgucaacaucgagaaguccaacgacaccgcguacgacuacgugcugaacaaguacggcgagcaaggaauccuggacuacaagaaccggaucgagaaccucuacaaggacagcaagaucucccgcacgaaguaccagaagcugaugaugaaaaacagcgacaucuccggaaacuucaucgagcgggagcugcgcgacagccaguacaucgccaagaaggcccgggagauccucgaggagcuggugaaguucgucgugccgaccaccggcuccgugaccgcccgccugcgugaggacuggcagcucgucgacgugaugcaggagcugaacuggaagaaguacgacaagcugggccucacggacgugcgcuacgacaaggacgggcgggagauccgcuauaucaaggacuggagcaagcggaacgaccaccgccaccacgccauggacgcgcugaccaucgccuucaccaagcggagcaucauccaguaccuaaacaaccucaacgccaaguccgacaagagcggcuccaucuacgccaucgagcagaaggagcuguuccgcgacaagcgggggaagcugaaguucaucccgcccaugcccugcaacaucuucagggccgaggcgaagcggcaccucgagaacguccuggugagcgugaaggccaagaacaaggucgugacccccaacaucaaccgcuccaagggcaagaacgggaucaacaagaagauccagcugacgccccggggccagcuccacaacgagaccaucuacggcagcaugaagcgcuacgagaccaagugggagaagaucggguccggcuucgacgagcggcagaucgccaagguugccaacaagaaguuucgcgaggcccugcugagccgccucgcugaguucgggaacgacccccagaaggccuucaccggcaagaacucccuggagaagaacccccuguacguggacgagcuccacacccagaaggugccggaaaaggugaagaucgucacccuggagaaccuguacaccauccggaaggagaucacccccgaccucaaaaucgacaagguaguggacgccgggguccgccgggugcugcaggagcgccuggacgaguucgacgacgacagcaagaaggccuucuccaaccucgacgagaaccccaucuggcugaacggcaaaaagaugaagcgggugacgaucaugggcgucagcaacgcggugccccugcacgacaagaaagacuacaaggggaaccucguguucgacuccaagggccgcaagcagccggucgacuucgugaacaccgggagcaaccaccacguggccaucuaccgggaugaguccggcgagcugcaggacaucgucgugagcuucuacgaggccaccacccgcagcacgcuggggaucccggucaucgacaaggaguacaagaaggccgagggcuggaacuuccuauucaguaugaagcagaacgaguacuucgucuuccccaacgaggagaccggcuucaaccccaaggagaucgaccugaugaaccccgacaacuacaccaccaucucccccaaccuguaccgggugcagaaguucagcaagugcauguacgggaacagcuccgugcgcgaguacgucuuccggcaccaccucgagacgucagugaacgacuccaagggccugaagaacaucgccuacaagaacgucaagagccugguguaccucgaggggaucgugaagguacgcaucaaccacaucggacagaucgucuccgugggggaguacuga

SEQ ID NO: 7839 - RNA, 4140 nt, Artificial Sequence
  Cas9 variant
augcgcaucgacaacggccuugaggagcucaaggugaacaaccggaucuacaacaucgggcuggacaucggcaccagcuccgucggguuugccgugaccgaugcccaggacaagcugguacgcgucaagggcaagacggcgaucggcgugcggcuguucgaggagggccacaccgccgccgagcgccggggcuucaggaccacccggcgccggcugagccgccggaaguggagaaucaaccugcucaaccagaucuucgagcccuacaucuccgagaucgacccgacguucuucgcccggcugaagaacagcucccuggccgggaaggacaagaaguucgagggcucucuccuguuccccgaccgcaccgacuaccaauucuacaaagacaaccccaccauguaccaccucaggaaacaccucauggagaaggaccgccaguucgaccugcgagagaucuaccuggccaugcaccacaucaucaaguaccgcgggaacuuccucaacaccacgcccaugaaccacuucaagaacgaggaaaucgauuucuccgcccuguucucgcggcugaacgagcucuaccaggagaucgacgacgagaacaucuucgagcugaacaucgagaacguggacgagaucaagaagauccugcucaaccacgaccuguucaagauggagaagcagaagcaggucgcgaaauuacucaauguggacaccgacgacaagcagcugaagaaggagaacaccgcccuggcgucaaacuucagcaaagccaucuugggcuacaaguucaaucuggcccuggugaccaagaucccggaccaggacaagaaggaguggacgaucucccucggggacgaggacuucgacgaccgccuggacaacguccccguggcccugaccgaaagccagcucgaggugguugagguccugcacuccaucuucaacagcaucucuuuaaacgagaucguggagaacggcgagacccucagcuccgccaugguccggaaguacaacgaccacaagcacgaccugaagcugcucaagaacgugaugaccacgcuggaggaucgcaagaaggcgaagaagauccaaggcaucuacaacguguucgucgggaaggacacugaccugaucucagacaaggacaagaacaaguacaaggacaaggacgaguucuacaaggaaauccagaagaaccucgacaacuccagcgacgccgaggagaucaucaagcgcaucaagcaggaccaguuccugcccaagcagcggaccagcaagaacggcgugaucccccaccagcugcaccagcgcgagcucgaccugaucaucgagaaccaggccaaguacuacccguuccugaaggaggccaaccccaacaagaagcggcucaagcaggccaaguacaagcuggacgagcugauugcguuuaagauccccuacuacaucgggcccaccuccggcgccgagaacagcgacuucuccuggcucaagcgcaagaaggacggccagaucacgccguggaacuucgacgagaagguggaccggaucgagagcgccaaccgcuucauccggcgcaugaccaccaaggacaccuaccuccuggccgaggacguccugccccucgagucccugaucuacgagaaguacagcgugcugaaugagcucaacaacgugcggaucaaccgccagaagcuguccgucaacgacaagcaggacaucuacaaugagcuguucaagaacagcaagacggugacucucaagcagcugcagaaguacuucgaggucaccaagaagcugaagaccgugguggucgaggggcucgccgacccgaagaaguuccuguccaaccugggcacguaccacgacuucaagcucauuuucggggacaucguggacgaccccgaguaccagaccgaccuggagaacaucaucgaguggagcaccauuuucgaggaccggggcaucuucaacuccaagcugaacgaaaucaccuggcugacggacgagcagcgcaagaagguccugagcaagcgguaccagggguggggccgcuucuccaagaaacugcucgucggccugaagaauagccaagggaacuccauccuggacgagcucuggaacaccaaccugaacuucaugcagcugcagagccaggacgauuucgcggagcucauccacgccgagaacgccaagcaguucaaggccaacgacccggacaaccccuggaacggcaucgacgccauccugaacgacgcguacaccagcccucagaacaagaaagccauccgccagguggugaaggucgugcaagacaucgagaaggccauggggaacaagccccaaaagaucgccaucgaguucacccggagcgcggacaagaacccgcggcgcacggacuccaggaucaagcgccugagcgacaucuacaaggaagccgccgagaagguggucggcgagagccucaagcuggagcugaacgaguaccucaccucgaagaagaagaugacugacaagauguaccuguacuucacccagcuggggaccgacaucuacaccggcaagaagaucgacaucgaccagcucaacaacuacgacaucgaccaugugcugccccagucuuuccugaaggacgacucccucgacaaccgcgugcugaccaaccggagcgacaacuccgaaaaguccgacaccgucccccugcacaaguucggcgccaagauggggaacuucuggaggcagcucgccgacgagggccugaucacuaagcggaaguacaagaaccugacgaccgaccccgcgaccaucgacaaguacaccauccagggguucauccgccggcagcucguggagacgucccaggugaucaagcucaccgcgaacauccugggcgggcucuacccggaggagaccgagauccuggagauccccgccaagcugaaccaccaguuccgcgacauguucgaccucgucaaggugcgggaggugaacgacuaccaccacgccuucgacgccuacaucaccgucuucguggguaacuuccucuaucgccgguaccccaagcugcgcagcuacuucguguacggcgacuucaagaagcucaacaagacggacgacgacauacggaaguucaacuuucugaaccuguucaacaaggacaaggucgaggacaacgagaccgacgagauccucuggucaaaggcggagagcauccgcgacaucaagaacaucuacaacuacaaauucaugcuggugucccgagaggucuacacccgccacggggccauguucaaccagaccaucuaccccgccagcaagaacgacuccaagaagcugaucccgaucaagaagggcaaggacacggccaucuacgggggcuacagcggcaacaccgacgccuacauggcgaucgucgccguggaggacaagaagggggagaaauucaagguggucggcgugcccacccgggccgugucccgccucgagcagcuggccgcggacgaccaugaccaguacuugaccgcccuccacgacguccugaagcccaacuucacuaaaaucaagaccaaccggaagaccaaggccaaggaggaggugaccacgccguuccgcauccugguggggaaggucggcuaccggcagcuuauccaggacggccaggugaagaugaugcuggggagcuccgccuacaaguacaacgcuaagcagcuggugcucagcgagaagucccugaaagucaucaagaacaacaagaaguacaacccugacgaugagaaccaggaccugaucgacguguacgacgagauccucggcguggucaaucgcgcguucaaccuguacgacaccaacggguuccggaagaagcugaacgacaaccgcgugaaguucguggagcuccccaucaacaacaucuucgacggcaccaagcugguccagauggggaagcgcgccgugcugacacagauccucaacggccugcacgccaacgccgcccugggcgacuuaaaggcgcugggcaucagcacgcccuucggcaagaugcaaagcaaguccgggauuccgcugagcauggacgccucccucguguaccagagccccaccggccuguucgagcggaagcugaaccucuccgaccuguga

SEQ ID NO: 7840 - RNA, 4140 nt, Artificial Sequence
  Cas9 variant
augaccaagaagaacuacagcauuggccuggacaucgggaccaacuccgugggcugggccgucaucacggacgacuacaaggugcccgccaagaagaugaaggugcucggcaacaccgacaagaaguacaucaagaagaaccugcugggcgcgcuccuguucgacagcggugagaccgccgaagccacccgccucaagcggacggcccgccggcgcuacacccggcgcaagaaccggcuccgcuaccugcaggaaaucuucgccgacgaaauggcgaaggucgacgaguccuuuuuccagcggcuggacgagagcuuccuccgcugggacgacgacaacaagaaacuuggccgguacccgaucuucggcaacaaggcagacguggugaaguaccaccaggaguuccccaccaucuaucaccuccgcaagcaccucgccgacuccagcgagaaggccgaucugcggcuggucuaccucgcacuggcccacaugaucaaguuccgcggacacuuccugaucgagggggagcucaacgccgagaacaccgacgugcagaagaucuucuccgauuucgugcggguguacgaccgcacguucgacgacagccaccuguccgagaucaccguggacgccgcgagcauccugaccgagaagaucuccaagagccggcgccucgagaaucugaucaaguacuacccuaccgagaagaagaacacgcuguucgggaaccucaucgcgcuggcccugggccuccagcccaacuucaagaugaacuucaagcuguccgaggacgccaaguuacaguucagcaaggacuccuacaacgaggaccucgaggaacugcuggggaagaucggcgacgacuacgccgaccucuucaccuccgccaagaaccuguacgacgcgauccugcucucuggcauccugaccguggacgacaacagcaccaaggccccgcuguccgccagcaugaucaagcgguacgccgaacaccacgaggaccucgagaagcugaaggaguucaucaaggccaacaagagcgagcuguaccacgacaucuucaaggacgagacgaagaacggguacgcgggcuacauagagaacggggucaagcaggaugaguucuacaaguaccucaagaacacccuguccaagaucgccggcagcgacuacuuccuggacaagaucgagcgcgaggauuuccuucggaagcagcgcaccuucgacaacggcuccauaccccaccagauccaccuccaggagaugcacgccauccugcgccggcagggggacuacuaccccuuccugaaggagaaccaggaccgcaucgagaagauccugaccuuccggauccccuacuacguuggcccgcuggcccgcaaggacagccgguucaguugggccgaauaccacagcgacgagaagaucacgcccuggaacuucgacaaggugaucgacaaggagaaguccgcggagaaguucaucacacgcaugaccuuaaacgaccucuaccugcccgaggagaagguccugcccaagcacagccacguguacgagaccuacgccguguacaacgagcucacgaagaucaaguaugucaacgagcaggggaaggacuccuucuucgacagcaacaugaagcaagagaucuucgaccacguguucaaggagaaccggaaggugaccaaggagaagcugcugaacuaccucaacaaggaguucccggaguaccgcaucaaggaccugaucggccuggauaaggagaacaaguccuucaacgccagccuagggaccuaccacgaccugaagaagauccuggacaaggccuuccucgacgacaaggucaacgaggaggugaucgaggacaucaucaagacccugacucuguucgaggacaaggauaugauccacgagcggcuccaaaaguacuccgacauauucaccgcggaccagcugaagaagcuggagcgccggcacuacacgggcuggggccgccucagcuacaagcugauaaacgggauccggaacaaggagaauaacaagaccauccuggacuaccucaucgacgacggcuccgccaaccgcaacuucaugcagcugaucaacgacgacacgcugcccuucaagcagaucauccagaagucccagguggucggggacguggacgacauagaggccgucgugcacgaccuccccggcucucccgccaucaagaaggggaucuuacagagcgugaagaucgucgacgagcuggugaagguaaugggcgacaacccggacaacaucgucaucgagauggcccgggagaaccagaccaccaaccgcggccggucccagagccagcagcgcuuaaagaagcugcagaacagccugaaggagcucggguccaacauccugaacgaggagaagcccagcuacaucgaggacaagguggagaacucccaccuccagaacgaccagcuguuccuguacuacauucagaacggcaaggacauguacaccggggacgagcuggacaucgaccaccugagcgacuaugacaucgaccauauuaucccccaggcguucaucaaggacgacuccaucgacaaccgggugcugacgagcuccgccaagaaccgcggcaagagcgacgacguccccucccuggauaucgugcgcgcccggaaggccgagugggugcgccucuacaagagcggacugaucuccaagcggaaauucgacaaccugaccaaggccgagcgcggcggacucaccgaggcggacaaggccggguucaucaagcggcagcuggucgagacccgccagaucaccaagcacguggcccagauucuggaugcccgguucaacacggagagugacgagaacgacaaggugauccgcgacgugaaggugaucacccucaaguccaaccuggugagccaguuccggaaggacuucgaguucuacaagguccgcgagaucaacgacuaccaccacgcccacgacgcguaucugaacgccguggugggcaccgcccuccugaagaaguacccgaagcuggccuccgaguucgucuacggggaguacaagaaguacgacgugcacaagcucaucgccaagagcuccgacgaccacagcgagaugggcaaggcgaccgccaaguacuucuucuacagcaaccugaugaacuucuucaagcggguuauccgcuacuccaacggcaaggucaucgugcggccuguggucgaguacagcaaggacacggaggacaucgccugggacaagaaguccaacuuccgcaccaucugcaaggugcugagcuacccccaggugaacaucgucaagaagguggagacccagaccgguggcuucuccaaggagagcauccuccccaagggggacuccgacaagcugaucccgaggaagacgaagaaggccuacugggacaccaagaaguacggcggguucgauagccccaccguggcguacuccgucuucgugguggccgacgucgagaagggcaaagccaagaagcugaagaccgugaaggagcucgugggcaucagcaucauggagcgcuccuucuucgaggagaaccccgucgaguuccuggagaacaagggguaccacaacauccgggaggacaaacuuaucaagcuccccaaguacagccuguucgaguucgagggcgggaagcgccggcugcucgccuccgccagcgagcugcagaagggcaacgagauggugauaccggggcaccuggugaagcuccuauaccacgcgcagcgcaucaacucguucaacagcacgaaguaccuggacuacgucuccgcccacaagaaggaguucgaaaaggugcucagcugcguggaggacuucgccaaccuguacgucgacguggagaagaaccugagcaagauccgggccguggccgacagcauggacaacuucagcaucgaagagaucuccaacagcuucaucaaccuccugacccugaccgcgcucggcgcccccgcagacuucaacuuccugggagagaagauaccccgcaagcgcuacaccuccacgaaggagugccugaacgccacacucauccaccagagcaucaccgggcuguacgagacccggaucgaccuguccaagaucggugaggaguga

SEQ ID NO: 7841 - RNA, 4143 nt, Artificial Sequence; identical to SEQ ID NO: 2041
  Cas9 variant

SEQ ID NO: 7842 - RNA, 4143 nt, Artificial Sequence
  Cas9 variant
augaagcgcauacugggccucgaccuggggaccaccagcauaggcugggccuuaguaaacgaggccgagaacaacaacgaagcguccagcaucgugaggcucggagugcgcgugaacccccugaccgucgaugagaaauccaacuucgaaaagggcaaggccaucaccaccaacgcugaccgacagcugcgccacggggcccggauuaaccuccagagguacaagcugaggcgccagaaccuucacgacugucuccagaagcagggcuggcuagggaccgaggcgauguacgaggaagggaaagcgagcacguucgagacuuacaagcugcgggccaaagcggccgaggaggaaauaucgcuccacgaguucgcgcgcgugcuauucaugcugaacaagaagagaggcuacaagagcaaccgcaaagccaacaacaaggaggacgggcagcuguucgacgguaugaccaucgcgaagaaacuauacgaagaacaccucaccccggccgaauacagccuccagcuccugaauaaggggaaaaaguuuacccagggcuacuaccggagcgaccucaacgccgagcuggagcgcaucugggaugagcagaagaaguacuaccccgagauucugaccgacgaguucaagcagcaguuggagggcaaaacuaagaccaacacguccaagauuuuccuggcgaaauacgggaucuacagcgcugaucuuaagggccucgaccguaaguuccagccccugaaguggcgcguugaggcccugcagcagcaggucgacaaggaagugcucgccuucgugaucuccgaccuaaaggggcagaucgccaacaccucgggccugcucggagcgauuuccgaccgcagcaaggagcuguacuucaacaagcaaaccgucgggcaguaccugugggcuucccuagaggagaauccccacaucagcaucaaaaacaagccuuuuuaccgccaggacuaccuggacgaguucgagaagaucugggaaacucaggccgccuuccacaagcagcugacccccgagcucaagcaggagauccgggacaucaucauuuucuaccagcgcccacugaaguccaagaaauccuuaaucaguguaugcgagcucgagcagcggaaggugaaggccaccaucgacggcaaggagaaggagaucaccaucggacccaagguugcgcccaagagcagcccggucuuccaagaguuucgcaucuggcagaaccugaacaaugugcugcuuaucgacaaugacacaaaugagaagcgcccccuggacgaggucgagcggaaccugcuauacaaagagcuguccaucaaggccaagcugagcaagacggaggcccugaaaauccucaacaagaagggcaaacaaugggaccucaacuaccgcgagcuggaggggaaccggacccaggccauccucuucgauugcuacaaucgcauaaucacccugaccggccacgaggagugcgacuucaaaaagauuaaggccuccgaaauccggcacuacgugaguacgauuuuuaagaaccuuggcuucuccaccgagauccuugacuucgaccccagccuaaagaaacacgagcuggagaagcagccgauguaucagcuguggcaucuccuguacuccuacgagagcgacaauuccaggacagggaacgaaagccuccugcggaagcuggagaccacguucggcuuccccgaggaguaugcgacagugcucugcgacgucguguucgaggaggacuacgggaaccuguccgugaaggccaugcgcgagauccugcccuaccuccaggcgggcaacgacuacagccaggccugcgcguacgccggcuacaaccacucccggcacagccucaccaaagaggagcuggaccagaaggucuacaaggagcgccucgagcugcugccaaagaacucucuacggaacccgguuguggagaagauccugaaucagaugaucaacguaaucaaugccaucaucgacgaguacggcaagcccgacgagauccgcaucgagauggcacgggagcucaagucguccgccgcugaccgcaagaaaaccacgcacgccauuagccagggcaacgccgagaaucagcggauccgcgagauccuggagaaagaguucagccugagcuauaucagccggaaugacaucaucaaguauaaguuguaugaggagcucgagcccaacuacuacaaaacccuguacuccgacaccuacaucaccaaggacaagcuguucuccaaggauuucgacauagagcauaucauccccaaggcccgccucuucgacgacuccuucagcaacaagacgcuggaggcccgcaacaucaaccuggaaaagagcaacaagaccgcguucgacuucaucaaggagaaauauggggaggacggcgccgaggccuacaagaagaaacucgacaugcuguuggagaacgacgccaucagccgcccgaaguacaauaaccuccugcgcgccgaagcggacauccccuccgacuucaucaacagagaccugaggaacacccaguauaucgccaagaaggcaugcgagauccugggggagcugguuaagaccgucacccccacgaccgggaagaucacuaaccggcugcgugaggacuggcagcucguggacgugaugaaggagcugaacuucgagaaguacgagaagcuggggcucaccgagauuguggaggaccgggacggccgcaagaucaagcggauuaaggacuggacgaaacgcaaugaucaccggcaucacgccauggacgcgcucgccaucgcuuuuaccaagcccagcuucauucaguaccugaacaacuuaaacgcccgauccaacaaaggcgacucuaucuacgcaaucgagaacaaggaguugcacuacgaggaggggaagcugcgguucaaugcaccuaucccaguuaacgaguuccgcgccgaggccaagcggcaccucuccgcuauccuggugagcaucaaggcuaagaacaagguuaugacccagaacguuaacaaaaucaagacuaaacacggcauaauuaaaaagauccagcuuacgccccgcgggccucuccacaacgagacgaucuacggcaccaaaaugcgcccgauuauaaagauggugaagguuggcgcggccuuagacgaggccaccaucaacaagguguccucucccgccauacgcgaagcccugcucaagcggcugaacgaguacuccgggaacgcgaagaaagccuucacgggcaagaacacucuggaaaagaaccccaucuaccucaacgcagggcgcaccaagaccgugccgagccuggucaagacaguggagugggaguccuuccaucccaccaggaaacugauagacaaagaccuuaacgucgacaaggucguggacaaggggauccgugagauccucaaggcacggcuggaggaguuuaacggagacgcgaagaaggccuucagcaaccucgaggagaaccccaucuaccuggaugaggccaagaagauagcccugaagcgcgucagcauugaaggcgugcucuccgccaucccccugcauacccuaaagaaccaggcgggcaagccgaucacggggaaagacggcaagcccgugcucggaaauuaugugcaaacgagcaacaaucaccacaucgcauucuacuacgacgaggacggcaaccugcaggauaacgcggucucuuucuucgaggcugcugagcgcaaaagccaggggauucccgugauagauaaggacuacaaccgggacaagggauggcgcuucuuauuuaccaugaagcaaaacgaguacuucguauuccccaacgaggcgaccggcuucaucccguccgaggucgaccugacagacgaagccaacuacgggauuaucucgccgaaccuguaccgggugcagaagguaucccgcaucgacaagggcacgagcgccucccgggacuacugguuccgccaccaccuggagaccaucuuaaacgacgacgccaaguuaaagaaccuagccuucaagcggauucgcgggcuauuggagcugaaggacaucaucaagguccggaucaacagcaccggcaaaaucguugcggugggggaauacgacuga

SEQ ID NO: 7843 - RNA, 4143 nt, Artificial Sequence
  Cas9 variant
augaagaaaauccugggcuuagaccuaggaacuaccagcaucggcugggcccuggugaacgaggccgagacggaguccgaaaagagcucaauuauccggcucgggguccgggugaauccgcucaccaucgacgagaagggcaacuucgagaaggggaaagcaaucaccaccaacagugaucgccagcagcggcacagcgcccgcaucaaucugcagcgguacaagcuccgccggcagaaccucugcgacugccugcagaucggcggccuccuggggucugagucaauguacgaggaaggcaaagagagcacauucgagaccuacaaguuacgcgcgaaagcugccaccgagaagguggcgcuccacgaguucgcccggauccuguucaugcugaacaagaagcggggcuauaaguccaacagaaaggccaauagcaaggaggacggccaggccuuugacgggaugaccaucgcgaagaaacucuacgaggagaaccugaccccggcggaguacucccugcaacuccugaacaaaggcaagaaauucagccccuccuacuaccgcagcgaccuggaguccgagcucaaccggaucugggaagaacagaaaaaguacuaccccgagaucuuaaccgacgacuucuaccagcagcuggagggcaagaccaaggucaacaccacaaagaucuuccucgccaaguacgggauauacaccgccgaccugaagggccucgacaaaaagaugcaaccccuuaaguggcgcaucgaggcccugaacaagcaggucgacaaggagguguugacuuucguggucagcgaccugaaggggcagaucgagaagacauccggccugcugggcgagaucagcgaccgguccaaggagcucuauuucaacaagcagacgguggggcaguacgucugggcgucgcucaaggagaacccgcacgugagcaucaagaauaagcccuucuaucgccaagacuaccuggacgaguucgagaagaucugggaaacccaggccgccuuccacaaggagcuuacccccgagcugaagaaggagauccgggacaucaucaucuucuaccagcguccccugaaguccaagaagggccucauuagcaucugcgaacuggagcagaagaaagagaaggugaucaucgaggggaaggagaaggagauucugaucggcuccaaagucgcccccaagucuucccccauguaccaggaguuccggaucuggcagaaccucaacaacguguuacugaucgacaccgaaaucaaugagucucgcccccucgacgaggaggagaaggcccuguuauacaacgagcuauccgugcgggcgaaacuuucugagacagaggcacugaagaccaucaacaagaaggggaagcacugggaucugaauuucaaggagcuggagggcaaccgcacccaggccguccuguucgagugcuacaaccgcauaaucacccagacgggccacgaggaaugcaacuucaagaagaucucggccgaggacauccgccacuacguggcaaccauuuucaaaaaccugggguucaacacagacauccucgacuucaaccccagccuggagaagcacgagcuggaaaagcagccgauguaccagcuguggcaccuccuguauucuuacgagucugacaagucccgaaccggcaacgagagccugcuuaacaagcuggaggcgaacuucggguucccccaggaguacgccucuguguuagcugacgccacguucgaggacgacuacgguaacaucuccgucaaggccauuagaaaaauccugccacacuuacacgacggcuacgacuauuccgaggcgugugagagagccggguauaaucacagcgugcggucccugacgaaggaggaguuagcucagaagguguacaaagaccgcuuagaccuccugcccaagaacagccugcggaacccggugguggagaagauccuuaaccagaugaucaacgugauuaacgcaaucaucgucgaguacggcaagcccgacgagaucaggaucgagauggcgcgugaguuaaaaagcuccgccgccaagcgcgaggaacggaccaagagcaucaaccagaacgccgccgaaaacaagcgcaucacagagauccugcagacagaguucgggcugucguacaucagccggaacgacaucguaaaauacaagcuguaccaggagcuggaggcgaacggcuucaagacccucuacucuaauacuuacauccccaaggaaaagcuguucagcaaagacuucgacaucgagcacaucguccccaaggcccgccuguuugacgacuccuucgggaacaaaaccauugaggcacgggacgugaaucucgccaagucuaauaagacggcguucgacuucgugaaggagaaguacggcgagcaggggauagaggaguacaagaagaagcuggacaccuugcucaaggagaaugcgaucucuaguggcaaguacaagaagcugaugauguccgaggccgacaucccgagcgacuucaucaaccgcgaccugcggaacacccaguacaucgcccgcaaggcauaugaaauccucggcgagcuggucaagaccaucacccccaccacggggaaaaucaccgacaggcugcgcgaggacuggcagcuaaucgacgugaugaaggagcugaauuucgagaaguacgaccgccugggccucaccgaggugaucgaagaccgggacgggcgcaagaucaagcggaucaaggacuggacgaagcgcaacgaccaccggcaccacgcuauggacgcgcugaccaucgcuuucaccaagcccuccuauauccaguaccugaacaaucucaacgcccgcagcgacaaguccggcuccaucuacgcaaucgagacgaaggagcuccaccgggagaacaacacgcugagguucaacgcgcccaugccgcucaacgaguuccggaaggaagcuaagcgccaucuguccgccauccuggucucaaucaaggccaagaacaaggugaugacccaaaacgugaauaagaucaagaccaaaaacggcaucaucaagaagguccagcucacuccgcgcggggccuuacacaacgagacgaucuacggcaccaagaugcggcccaucaucaagauggugaagaucggggcggcucuggacgaggccaccaucaacaaggugagcuccccaaccauccgggaggcacucuuaaagcgcuuaaacgaauacaguggcgacgccaagaaggcguucgccgggaagaacgccaucacgaagaacccgaucuacuuaaacgccgagcacaccaaaaccgcccccgcgauggugaagaucguggagugggagauguacuaccccauccggaagcugaucaccccggaccugaaaauugagaaggugaucgacaacggcaucaaggagauccucaagaagcgccuuaaggaguucggcggggacgcaaagaaggccuuuuccaaccuggacgagugccccaucuaccucgacgaggagaagaacaucacccugaaaagggucagcaucgaagggguacuguccgccauccccgugcacacacucaagaaccacgcggggaaggagaucaaggacgaggacggcaaggcuguccuaggggacuacgugcagaccucaaauaaccaccacguggccaucuaucaagacgccaagggcaaccugcaggacaacgucaucuccuucuucgaggccgcggagcgcaagucacagaacgugcccaucguggacaagaaccucaaccgggacaagggcuggcacuuccuguacaccaugaagcagaacgaguacuucgucuucccgaacgaggagacaggcuucgugccuuccgagaucgaccugauggacgagaacaacuacgagaugaucucacccaaccucuuccgcgugcagacaaugucgcgggucgacuacggaaagaccaucauacgcgaauaugucuuccgcaaccaccucgagaccaucuugaacgacaaccucaaacugaaagggcugguguucaagaagaucaagagccucaaggcccuugagggcaucgucaaggugcgggugaacgccaucgggaagaucgucgccgugggcgaguaugauuga

SEQ ID NO: 7844 - RNA, 4143 nt, Artificial Sequence
  Cas9 variant
augaagaagaaguacgccaucggcaucgacaucgggaccaacagcguaggcugguccgucgugaccgacgauuacaaggugcccuccaagaaaaugaagguguucgggaacacggagaagcgcuacaucaagaagaaccugcucgguacccugcuguucgacgaggggaacaccgccgagaaccggcgccucaagcggaccgcucgccggagauacacgcgucgccggaaccguauacuguaccugcaggagaucuucgccgaggagauuaauaagaucgacgacuccuucuuccagcggcucgacgacagcuuccugaucguugaggacaagcagggcuccaaacacccuauauucgguacccugcaggaggagaaggaguaccacaagcaguucccgaccaucuaccaccuccgcaagcaacuggcugacagcucccagaaggccgacauccggcugaucuaccucgcccuggcgcacaucaucaaguaccgugggcacuuccuguucgagggugaccucaagagcgagaacaaggacgugcagcaccuguucaacgacuucgucgagauguucgacaagaccguggagggguccuaccugagcgagaaccuccccaacguggccgacguccugguggagaaggucuccaagagccgacaccuggagaauauccuccacuacuuccccaacgagaagaagaacggccuguucgggaacuuccuggcacucgcccugggccugcagcccaauuucaagacgaacuucgagcucgcggaggacgccaagauccaguucucgaaggagacauacgaggaggacuuggaggaguugcucggcaagaucggugaugacuacgccgaccuauucaucgcaaccaagagccuguacgauggcauccuccuggccggcauccuguccaccacgaacagcaccaccaaggcaccccucagcucauccauggucaacagauacgaggagcaccaaaaggaccuggcccugcucaagaacuucauccaucagaaccugagcgacagcuacaaggagguuuuuaacgacaaacugaaggacggcuacgcaggcuacaucgaaggcaagaccacgcaggagaacuucuaccgcuucaucaagaaggccaucgagaagaucgacgguuccaacuacuucaucgagaagaucgagcgcgaggacuuccuccggaagcagcgcaccuucgacaacgggagcaucccccaccagauccaccuccgggagaugcaggcgaucauacgccgccaggcgaaauucuaccccuuccuggaggagaaccaggacaagaucgaaaagauccuuaccuuccggaucccguacuacgugggcccccuggcccgcgggaagagugaguuugccuggcugaaccgcaagagcgacgagaagauccgacccuggaacuucgacgagauggucgacaaggaaaccucggccgagaacuucaucacgaggaugaccaacuacgaccaguaccuccccgaccagaaagugcugccgaagcacagccugcuguacgagaaauucgccguuuacaacgaacucaccaagguacgcuacgugacggagcagggcaaguccuucuucuuugacgcgaauaugaagcaggagaucuucgacagaacguucaagguguaccgcaaggucaccaaggagaagcugauggacuuccugagcaaggaguucgacgaguuccggaucguggaccuccugggccuggacaaagacaacaaguccuucaacgcgagccucgggaccuaccacgaccugaagaagaucguguccgaggacuucuuagauaacagcgagaacgaggacauacucgagaacgucgugcugacccugacgcuguucgaggaccgcgagaugauccggaagcgccuugagaaguacaaggacguccugaccgaggagcagcggaagaagcucgagcgcagacacuacaccgggugggggcgccuguccgccaagcugaucaauggcauccgggacaaggugacgcgcaagacgauccucgacuacuuaaucgacgacgggaccagcaaccggaacuucaugcagcugaucaacgacgacacccucuccuucguggacgagauccgccuggcucagggcucuggcaaggccgaggacuaccgcgcggagguccagaaccuggccgggucccccgccaucaagaagggcauccuccagagucugaagaucguggacgagcugaucgaggugaugggguacgaccccgagcacaucgucguggagauggcccgggagaaccaguucaccaaccagggccgccggaacucccagcagcgcuacaaaaagaucgagaacgcgaucaagaaccucgacagcaaccugaacagcaagauccugaaggaguacccgacgaauaaccaagcccuccagaacgaccgucuguuucuguacuaccuccagaacgggaaggacauguacacagacgaggagcuggacaucgaccagcugucccaguacgacaucgaccacaucaucccucaggccuucaucaaggacgacagccucgacaacaaggugcuaaccaagagugccaaaaaccgcggcaagagcgacgacguccccucccuggagaucguguacaagaagaagaacuucuggaagcagcuccuggacagccagcugauaucccagcggaaguucgacaacuuaaccaaggcugagcgcggcgggcugaccaacgaggacaaggcccgguucauccagcgccaacugguggagacacggcagaucaccaagcacgucgcccgcauccuagacacccgguucaacaccaaacuggacgaggccggcaaccgcauccgggacccaaaggugaacaucaugacgcucaagagcucgcucgugucccaguuccgcaaggacuaccagcucuacaagguccgggagaucaacaauuaccaccacgcccacgacgccuaccugaacgcggugguggccaccgcccuccugaaaaaguacccccagcuggccccggaguucguguacggggacuaccccaaauacaauuccuacaagagccgcaagucggccacagagaaagugcuguucuacagcaacaucaugaacuucuucaagcgggugcuggucuacuccaagaccggcgagguuaggauccggcccgugaucgagguaaacaaggagacgggcgagaucgugugggacaagaaguccgauuuccggaccgugcgcaagguccugagcuacccccaggugaacguggucaagaagaccgaggugcagaaccacgggcucgaccggggcaagccgaagggguucuacaacgcgaaccugaguccccgcccaaaggagggcagcguggagaaccugguccccgccaagcaguccuucgacaccaagcgguacgggggcuacgccggcaucagcaacuccuacgccgugcucgugaacgggaucaucgagaagggcaagaagaaguccaaggcggaggucacggaguuccaggggaucagcauccuugcccgcaaggacuucgacaaaaacccgaagcaguaucugcucaaccugggcuacaaggacaucaagagcauuauaaagcugcccaaguacucccucuucgagcuggagaaugggagucggcgcaugcuggcaucgauucucagcaccaauaacaagcguggcgagauccacaagggcaacgaaauguaccugcccgacaaguucgucacccuucuauaucacgccaugcgcgugaaccggacccuggagccggggcacaagaaguacguagaggcacaccgccacguguucgacgagcugcucacguacauccuggaguacaacgagaagaucgugggcgcgaaggccaacgggaagcggaucgucgaggccuacuccgcccgcaaggacaccgacaaccuggaggaacucugcaacagcuucaucaacuugcugaaccucaccgcccuuggcuccgcgguggacuucgaguucuuagggaccaagaucccccgguaccgcgacuacacgcccucuucccuccugaaggccacccugauccaccagagcgugaccggccucuaugagacccggaucgaccucuccaagcugggcggggacuga

SEQ ID NO: 7845 - RNA, 4143 nt, Artificial Sequence
  Cas9 variant
augaagaagauccugggccucgaccuggggaccaccagcaucggcugggcccugguguacgaguccgagaacgccgacgagaaguccuccauuguccgccucggggugcgggugaacccccugagcgucgacgagaagggcaacuucgagaaagggaaguccaucacgaccaacgcggaucgccagcagacccacggcgcccggaucaaccuacagcgcuacaagcuccggcgcgagaacuuaaaggacugccuucagaagcagggauggauagggaccgaggcccucuacgaggagggcaagacgagcaccuucgagaccuacaugcugcgggccaaggccgcggaggaggagaucucccugcaugagcucugccgcguguuauucaugcugaacaagaagcgggguuacaagucuaaccgcaaagccaacaacaaagaggacggcaagcuguucgacgggaugaccguggccaagaagcuguacgaggagcaccugacgccagcugaguacucccucaagcugcugagcuccggcaagaaguuuaagcaggaguacuaccggagcgaccucaaagaggaguucgaccgcaucuggaacgagcagcagaaguacuacccagagauccugaccgacgacuucaagcagcagcugcagggcaaguccaaggggaacaccagcaaaaucuuccucggcaaguacgggaucuacuccgcggaccugaagggccuggaccggaaacuccagccccugaaguggcgcgucgaggcccugaagcagaagguggacaaggaggugcucgccuucgucaucagcgaccuuaacggccagaucgccuccaccagcggccugcucggcgccaucuccgaccggagcaaagagcuguacuucaacaagcagacgguggggcaguaccuguggaccagccucaaggagagcccccacgugagcaucaagaacaagccguucuaccgccaggacuaccuggaugaguucgagaagaucugggagacccaggcgacauaccacaaagagcugacgcccgagcucaagcaggaaauccgggacaucaucaucuucuaccagcgccccuugaaguccaagaagggccugaucagcgucugcgagcucgagcagcggaaagugaaggugaccaucgacgggaaggagaaagagaucuccaucggccccaaggucgcccccaagagcucccccauguuccaggaguuucgcaucuggcagaaccugaacaacauccugcucaucgacaagggcaacaacagcaaccggccccuguaugaggaggaacgcaaccugcucuacgaggagcuguccgugaaggagaagcugagcaaggccgaggcccugaaggugcucaacaagaacggcaagcagugggaccugaacuacaaggagauagagggcaaccgcacccaggccguccucuacgacugcuacaaccggauaaucgggaugaccggccacgaggagugcaacuucaagaagcucaaggcguccgacauccgcuacaacgugaagacgaucuucaagaaccugggguucagcaccgacauccuggacuucgauucuagccugcagggccacgagcuggagcggcagcccuccuaccagcuguggcaccuccuguacagcuacgaguccgacaacagccgcacuggcaacgacgcccuguuacggaagcuggagaccgccuucuccaucccgaaggaguacgccgccgugcugagugacguuguguucgaggacagcuacgggaaccucuccgugaaggcaaugcgcaacauccuaccccaccuccaggccggccucgacuacagccaggccugcgagaaggccggguacaagcacucccggcgcagccugacgaagaacgagcuggacaaaaaggaguacaaggagaagcucgagcugcugcccaaguccagccuccacaaccccgucguggagaagauucugaaccagaugaucaacgucaucaacgccgugaucgacgaguacggcaagcccgacgagauccggaucgagcucgcgcgcgagcucaagaucggggccgccgagcgggagaacaugacccgcuccaucaaccagggcaacgccgagaacaagcggauccgcgagauccuggagaaggaguuugcgcugagcuacaucuccaggaacgacaucaucaaguacaagcucuacgaggagcucaagagcaacggcuucaagacccuguacuccgacaccuacaucucgaaggauaagcuguucucaaaggacuucgacaucgagcacaucauucccaaggcccgccuguuugacgacagccuguccaacaagacgaucgaggcccgggacgugaacaucgccaagagcaacaagacagccuucgacuucaucuccgagaaguacgaccagcaggggaucgaggcguacaagaagaagcucgacauccugcugcaggacgguagcaucagcaaggccaaguacaaccgccuccugaugaaggaggccgacauccccuccggguucaucgaccgggaccugcgcgacacccaguacaucgccaagaaggccuacgagaucuuaagcgaccugguccgcaacgugacccccacgaccggcgcggugaccucccggcugcgcgaggacuggcagcucgucgacgugaugaaggaguuaaacuuugagaaguaccagaagcugggccucguggaggucaucgaggaccgggacgggcgcaagaucaagcguaucaaggacuggaccaagcgcaacgaccaccggcaccacgccauggacgcccugacgaucgccuucaccaagccgagcuacauccaguaccucaacaacuuaaacgcccgcucagacaagaacagcuccaucuacggcaucgagaacaaggagcugcaccgggaggacaacaagcugcgcuucaacgcgccccuccccaucaacgaguuccgggccgaggcccgccggcaccucaagagcauccugguguccgugaaggccaagaacaaggucaugacccagaacgugaacgugaucaagaccaagcacggggucaucaagaaggugcagcugaccccgcgcggggagcugcacaacgcgacguucuacgggaccaagaagcggccgaucaucaagauggugaaggucggcgccgcccuggacgaggugaccaucaagaaggugagcagcagcuucauccgcgaggcccuccuggaccggcugcacgaguacaacggcgacgccaagaaagcguucaccgggcgcaacuccaucgacaagaaccccaucuacauagacgaggagcacaagaagacgguccccgcccucgugaagaccaucgagugggagauguaccaccccacccggaagaugaucagcccggaccugaagaucgacaaggugaucgacaagggcauccgcgagauccugcggacccgccucgccaaguucaacggggacgcccagaaggccuucuccaaccuggacgagaaucccaucuacaaggacgaggcgaagaagaucacgcugaagcgcgucagccucgagggcguguccagcgugaucccccugcacaagcugaaggacaugggcgggaagccggucgugggcaaggacgggaagcccguguggggcgauuacguccagaccuccaacaaccaccacaucgccuucuacauggacgagaacgggaaccuccaggacgacguggugaccuucuucaaggccgcccggcgcaagagccagggcguccccgugauugacaagaacuacaaccacgacaagggguggcacuuccuguucaccaugaagcagaacgaguacuucguguuccccaacgaggccacgggcuucaucccgaccgaggucgaccugauggaugaagcgaacuacgacaugaucagccccaaccucuaccgggugcagaagaugucgaagacaaagcagggcaucaccgauaagcgcgacuacugguuccggcaccaccuggagacggugcugaacaacgaccucaaagucaggaacagcaucuucaagcagaucaacucccugaagccccuggaggggaucgugaaggugcggaucaacgccaucggcaagaucgucgccaucggggaguacgacuga

SEQ ID NO: 7846 - RNA, 4143 nt, Artificial Sequence
  Cas9 variant
augaagcgcauccuggggcuugaccugggaaccaccagcaucggcugggcccuggugaacgaggccgaguccaacaacgaagcgagcuccaucguccggcucggggugcgcguuaaccccuugacggucgacgagaaguccaacuucgagaagggcaaggccaucaccaccaacgccgacagacagcugcgccacggggcgcguaucaaccuccaacgcuacaagcugcgccgccaaaaccugcacgacugcuugcagaagcagggcuggcugggcaccgaggccauguacgaggaggggaaggcgagcacguucgagaccuauaaacuucgggccaaggccgccgaggaggagaucagccuccacgaguucgcgcgcgugcuguucaugcugaacaagaagaggggcuacaaguccaaccgcaaggccaacaacaaggaggacggucagcuguucgacggcaugaccaucgccaagaaguuauacgaggaacaccugaccccggccgaguacagccuccagcuguuaaauaaggggaagaaguucacgcagggcuacuaccggagugaccucaacgcugagcuggagcgcaucugggacgaacagaagaaguacuaccccgagauccugacagacgaguucaagcagcagcucgagggcaagaccaagaccaacacgagcaagaucuuccuggcgaaguacgggaucuacuccgccgaccugaagggacucgaccggaagcugcagccccugaaguggcgcguggaggcccucaagcagcaggucgacaaggaggugcuugccuucgugaucagcgaccugaaggggcagaucgccaacacuagcggccuccuaggcgcgaucagcgaccgguccaaggagcuguacuucaauaagcaaaccgucgggcaguaccucugggccagccuggaggagaacccccacaucuccaucaagaacaagccguucuaccgccaggacuaucuggacgaguucgaaaagaucugggagacccaggccacguuccacaagcaacucacccccgagcugaagcaggagaucagagacaucaucaucuuuuaccagcgaccccucaagagcaagaagucccuaaucagcgugugcgagcuggagcagcggaaggugaaggccaccauagacggcaaggagaaggaaaucaccaucgggcccaaggucgcccccaagagcucgcccguguuccaggaguuccgcaucuggcagaaccugaacaacgugcugcugaucgacaacgacacgaacgagaagcgcccccucgacgaagacgagcgguaccuccucuacaaggagcugagcaucaaggcgaagcuguccaagaccgaggcccucaagauccugaacaagaagggcaaacagugggaccugaacuacaaggaacucgagggcaaccggacccaggccauccuguucgacuguuauaaccggauaaucaccuuaacgggccacgaggagugcgacuucaagaagaucaaggccagcgagauccgccacuacguauccaccaucuucaagaaccugggguuuagcaccgagauccucgacuuugaccccucccucgagaagcacgagcucgaaaaacagccgauguaccagcuguggcaccuccucuacaguuacgaguccgacaacagccgcaccgggaacgagucccuacugcgcaagcucgagacgaccuucggcuuccccgaagaguacgccaccgugcugugcgacguugucuucgaggaggacuacgggaacuugagcgugaaggcgaugcggaagauacuacccuaccugcaggccggcaacgacuacucccaggccugcgccuaugcgggguauaaccacagccggcacucccugaccaaggaggagcucgaccagaaaguguacaaggagcggcuggagcugcucccaaagaacagccugcgcaacccggucguggagaagauccugaaccagaugaucaacgugaucaaugcgaucaucgacgaguacggcaagcccgaugagauccggaucgagauggcccgcgagcucaagagcagcgccgccgaccggaagaagacgacccacgcuaucaaccagggcaacgacgagaaucagugcaucagggagauccuggagaaggaguuugcacuguccuacauuagccggaacgauaucaucaaguacaagcucuacgaggagcugaagccuaacggguucaagacccucuacagcgacaccuacauccccaaggacaagcuguucuccaaagacuucgacaucgaacacaucaucccgaaggccaggcuguucgacgacagcuacuccaacaagacgcuggaggcccgggacauuaaccucgccaagagcaacaagaccgcguucgacuucgucaaggagaaguacggcgagcagggggccgaggccuauaagaaaaagcuggacaugcugcucggcaacaacgugaucuccaaacccaaguacaacaaacugcugaugaccgaggccgauauucccagcgacuuuaucaaccgcgaccuccggaacacccaguacaucgcccgcaaggcgugcgagauccugggggagcugguccgcaccgugacgcccaccaccggcaagaucacgaaccggcuccgcgaggacuggcagcugguggacgucaugaaggagcugaacuucgagaaguacgagaagcucggccucacugagaucguggaggaccgggacgggcgcaagaucaagagaauuaaggacuggaccaagcgcaacgaccaccggcaccacgccauggacgcccuggccaucgcguucaccaagccguccuauauccaguacuuaaacaaccugaacgccagaagcaacaagggcgacuccaucuacgccaucgagaacaaagaguuacacuacgaggaggggaaguugcguuucaacgcccccauccccgugaacgucuuccgcgccgaggcgaagcggcaccugagcgccaucuugguguccaucaaggccaaaaacaaggugaugacccagaacgucaacaagaucaagacgaagcacggcaucaucaagaaaauccagcucaccccgcgcggcccgcugcacaacgaaaccauauacgggaccaagaugcggcccauuaucaagaagguuaaggugggcgccgccuuagacgaggcgacuauuaacaaggucagcucccccgccauccgcgaagugcuccugaagcggcuuaacgaauacagcgggaacgccaagaaggccuucaccggcaaaaauacccucgacaagaacccgaucuaccugaacgccgaacgcaccaaaacugugcccgcguccgucaagaccguggagugggagaacuaccaccccauccggaagcccaucaccccggaccugaagguggacaagguaaucgacaaggggaucggcgagauccucaaggcccgccuggaggaguucaacggcgacgccaagaaggccuuuaguaaccuggaggagaaccccauauaucucgaccagaccaagaagaucgcgcugaagcggguguccaucgagggugugcugaguacgauuccucuccacacccugaagaaccaggccggcaagcccaucauggggaaggacggcaagccgguccuggggaacuacgugcagaccagcaacaaccaccacaucgccuucuacuacgacgaggacgggaaccuccaagacaacgccguuuccuucuucgaggccgcggagcgcaagagccagggcaucuccgucaucgauaaggauuacaaccgggacaagggguggcgcuuucuguucaccaugaagcagaacgaguacuucguguuccccaacgaggccacgggcuucaucccaagcgagguggaccugaccgacgaggccaacuacgggaucaucagcccuaaccucuaccguguacagaagaugagccggaucgagaagggcaccagcgugagccgcgacuacugguuccggcaucaccuggagaccauccugaaugacgacucccgccucaagaacagcgccuucaagcggaucaacucccugaagccgcuagaagggaucaucaagguucgcaucaacaguaucgguaagauagucgccgugggcgaguacgacuga

SEQ ID NO: 7847 - RNA, 4143 nt, Artificial Sequence; identical to SEQ ID NO: 2047
  Cas9 variant

SEQ ID NO: 7848 - RNA, 4143 nt, Artificial Sequence
  Cas9 variant
augaaucuacgacacguaggcaacuacaacaucgggcucgacaugggcaccgcgagcguaggaugggccgcaaucgacgaacaaggagaacuacugcacuucaaggguaaaccaacauggggcucgcgccuauucgacagugccaacacagcagcaacagcucguaugcccaggggccaacggcggcgauauaucagacggcgauggcgccucgacuuacuacaaaaauucuucuccgaagaaauggcggagaaggacccugaauuuuucauuagacuccgccaaucgagccuauggcccgaagaccgggagggaggucacaccgccuaccacuggccccuauucaaugacucagacuuuaacgaaaaagaauacuacgaaaaguuccccaccaucuuucaucuccgacaauggcuaauggaaacagaugaaaaagcagauauacggcugaucuaucucgccuuccacaacauagugaagcaccgcggcaacuucuuacaagaaaacaacgacucgcuaagugcucagaacgccaacaugcgggaguccuuagaaucguucuguauagcccucgaagaauggugcgacgagaaggaacucaccuguuccugcgacccacaaaagcuggaacaccuauucaaagaaguaaaauauagaucggacauacgggauggcuucgccgccuugcucggacuggccuguuccggggagaacgaaguugaugugaaagcaauggccaaagaaaugggcaaagcaauagugggcuacaaagcugacuucuccaagauauuuaccgagugcgacaaagaagggucgagcuuucgccuaucggacgacgaaggaccggaagccuuccuagacauaugccccgacgacgggaucgcccuauucgaagcgauccaaauggucuacagcucauucaucuuaaccggaaugcugacggaaaaaggccuaagccucagcaaaaucucagcauacaaccaauacggacaagaccucgaaucacucaaagcccuugugaaagaauaugugcccaacgaauacagcucauucuuccgcggaccgaccuacagcggaucaaccgaguacgacccaucaaaggcccaaggcuacacacguuacaaccucggaccgagcaagaaaggcuccggcgccaaaccaauggcuuacgaagauuucaagaagucagucgaacagcuguucgcuaacacaaacgcaaucaacgacgaaagauacaaagagaugaugggaagguucgcagaggaaaaguuucuacgacggcuacggaccuccgacaaugggcgcaucccguuucaacucaaccuugaagaaaugaccgccaucaucaucaaccagggaaaguacuacccguuucuccucgaacagcaagaaaaacuagaaagccuugugcgcuuccgcauacccuauuacgucgguccacugacgaggaucaacgcgcgcuuagacuccaaggguaacgcaugcuucgcaugguccaaaagaaaagacggaauggacagcgccagcauuaagccguggaacugggacgaaguaaucgacaaacacgcuagugcccaagcauucauagaaagaaugaccggaacaugcacauaccuacgaggcgagccaguccuaccaagaugcucgcuacucuaugaggaauacugcguucuuaacgagcucaacggcgcccgcuggacccaggacggggacaaguucauucgcuuugacuacaaagacagguccgacauaauugaagaacuguucaagaaacgcagggggcgcauacaauacgcagcagucgccgacuggaugaaacaggagcgaagccacgcgaauguacacguaagcggcggacaaggagagaacgcauucgagagcagacuuucuuccuaucauuucuuuugcaacgaugucuuugggguggacgaacucccaggcagcuacgucgacauggucgaggaaauaauacucuggagcacacuauucgaggaccguuccauucuccgagaagaaauccagagaaaauacggcgacguucucaacgaggaacaaauaaaaacgauauguaagaaacgcuucuccggaugggggagacugagccguaagcuccuaugcagccuaaaagcccaaacugacaacgggcccaaaagcaucauggacauacuacaagagggcgaucagaauaacgguagagucggcagagcaaugguauuccaggaaauccuacaugaugagcaacugggauucgaacagaaaauagaagaagaaaacacacaauccaugcuagagggagaaaaccuccuaaucgaagaccucccaggcagccccgcaauaaggcgcaguaucaaccaagccgugagaaucgucgacgaaaucgugggcaucgcgggccacgcacccgacaacauauucauugaggucacacgggaagacgacacaaagaagaaagggaagcgcaccacaaccagauacuccaacauacaaaaagcacuagaggcgcugaaggaagaaggugcagaagcccuacgggaacugaaaaccuacaagcacaaugagcuagacaaacgauuaagccuauacuucaugcaaaauggaaagucauuauacagugggaucccgcuagacauccgacgccucagcgaauaccagauagaccacaucaucccacagucguacauaaaagaugacucauacgaaaacauggcauuaguccuuccaggagaaaaccagagcaaagcagacaaucuauuaaucucacaagacauacgcaucaaaaugaaggcgacauggacagcccugcacaaagcaggccucaugggagacaagaaguacaacaaccuaaugaacucuucgauaucagacgcgaaaaugaagggguuuauaaauaggcaauuaguugaaacaagccaaucugugaaacucacacagaugaugcucucccagaaguauccaggagccaaaguccgccccauaaaagcauccaucagcucccagcuacgugaugcaugcgaccuagucaagugccgagaagccaacgauuaccaccacgcccacgacgcauaccuugccugccaagucggacgauucgugcucaagcggcacaguuccauguucgacaacccaaucgggaugacaaagguaauaagagacuucgucaagagacaaggacaggaguucaaacgaaacggcaaacuacccgcuuacgccucccgcuccggguucauagugcaauccuucaugcgaagcggcuucgacgcggaaaccggcgaacucuuaagggaugacuggaacgccccauucgagaucgcccgcauaaaaaggugccuaaauuaucgggacuguuauaucucgcgcaugcccauggaagacagcggagccuucugggacgcuacgauauauuccccaaaagcgggaaagaaaggcgcacuacccguaaaacaagggcuaccaguggaaaaauacgggagcuacagcagggaacaauuugcguacuuuuucgucuacaaggccuacaaccccaaaaagaaagcguacagacuagaguucgaagccgucccaguacgcgucgccuccgcagucgaaacgcgagaaaacgcccuggaagaauacgcuaaaagcguagccaaacaggcgggccuagaguucgucgaaguagcacggcccaaaguauauaaauaucaacuuaucgaacuaggagaagaccgucucuacauaacaggaaaacgcgaaguaaggaacgcaagccaacuagcguucucccucgacgagauagaccuacuaaaaagacuggccgaaggcgaggaaacauccucagaagaaagagaacgacuguucgauguacucaucgaaaaauaugccagguacgccccacgccuagcgcggcaacuaagcguagacaguaugucagccaccuucgaaacacucaacgcagaggagcaacugggcauacugcuaucccucguagaaauagccaacggaaaacgcaacaugaucgaccucucaucagccggagggucgaagaacgcaggaugcaugaacccaacguucucaucugaacucagcucgccaggcagcaacuucaccuucauagaccaaucgguuaccggaauguucgaaagaagacaacggcuagaacuguga

SEQ ID NO: 7849 - RNA, 4146 nt, Artificial Sequence
  Cas9 variant
auggugaagaagaaguacgccaucggcaucgacaucgggaccaacagcguaggcugguccaucgugaccgacgacuacaaggugcccagcaagaagaugaaggucuuugggaacacggagaagcgcuacaucaaaaagaaccugcuaggcacgcugcuguucgacgaggggaacaccgccgagaaccggcgccucaagcggaccgcgcgccggcguuacacccggcgccgaaaccgcauccuguaccugcaggagaucuuugccgaggagaucaacaaaaucgacgacuccuucuuccagcggcucgacgacagcuuccugaucgucgaggacaagcagggcuccaagcacccgaucuucggcacccugcaggaggagaaggaguaccacaagcaguuccccaccaucuaccaccuccgcaagcagcuggccgacuccucccagaaggccgacauccggcugaucuaccucgcccuggcgcacaucaucaaguaccgcgggcacuuccucuucgagggcgaccuuaagagcgagaacaaggacguccagcaccuguucaacgacuucgucgagauguucgacaagaccguggagggguccuaccugagcgagaaccuccccaacguggccgacguccugguggagaagguguccaagagccggcgccuggagaacauccuccacuacuuccccaacgagaagaaaaacggccuguucgguaacuuccuggccuuagcccugggccugcagccaaauuucaagaccaacuucgagcucgcggaagacgccaagauccaguucuccaaggagaccuacgaggaggaccuggaggagcuguuaggcaagaucggagacgacuacgccgaccuguucaucgccaccaagagccuguacgacggcauccuccuggccggcauccugucuaccacggacaguaccaccaaggcgccccucuccagcuccauggucaaccgguacgaggaacaccagaaggaccuggcucugcucaaaaacuucauccaccagaaccugagcgacagcuacaaggagguguucaacgacaagcugaaggacggcuacgccggcuacaucgaggggaagaccacgcaggagaacuucuaccguuucaucaagaaggccaucgagaagaucgagggcuccaacuacuucaucgacaagauagaccgggaggacuuccuccgcaagcagcggaccuucgacaacgggucuaucccgcaccagauccacuugcaggagaugcacgccaucauccgccgccaggcggaguucuaucccuuccugguggagaaccaggacaagaucgagaagauccucaccuuccggaucccguacuacgucggcccccuggcacgcgggaaguccgaguucgccuggcugaaccgcaagagcgacgagaagauccggcccuggaacuucgacgagaugguggacaaggagaccuccgccgagaacuucaucacgcggaugaccaacuacgaccgcuaccuccccgaccagaaggugcugccuaagcacagucugcuguacgagaaauucgccgucuacaacgagcucaccaaggugaaguucaucgcggagggcaugcgggacuaccaguuccuggacaguggccagaagaaggacaucgugaagacccucuucaagacgaagcgcaaggucaccgccaaggacaucaaggccuaccucgagaacagcaacggguacgccggcguggagcugaaggggcuggaggagcaguucaacgccucccuccccaccuaccacgaccugcugaagauccuucgggacaaggcguucaucgacgccgaggagaaccaggagauccuagaggacaucgugcugacccucacgcuguucgaggaccgcgagaugauccggaagcgccuggagaaguacaaggacauccucaccgaggagcagcggaagaagcuggagcgccggcacuacaccggcugggggagacugagcgccaagcucaucaacggcauccuggacaaggucacccggaagacgauacugggcuaccucaucgacgacgggaccuccaaccgcaacuucaugcagcugaucaaugacgacacccugagcuucguggacgagauccggcucgcccaggguuccggggaggcggaggacuaccgcgccgagguccagaaucuggccggcagccccgccaucaagaaggggauccugcagucccucaagaucguggacgagcugauugaggugaugggcuacgagcccgagcacaucgucguggagauggcccgcgagaaccaguucaccaaccagggccggcgcaacagccagcaacggaucaaccgccuggagaacgcgcucaaggacuucggguccaagauccuggaggagcagaagccguacggcgugagcaaggucaacaacauccaccuccaauccgaccggcuguuccuguacuaccugcagaacgggaaggacauguacacggacgaggagcucgacaucgaccaccugagcgaguacgacaucgaccacaucaucccccaggccuucaucaaggacgacagccuggauaacaagguacucaccaaguccgccaagaaccgcggcaaaagcgacgacguucccuccauggagaucguccacaaccggaagaacuucuggcgccagcugcucaagagcaagcugaucucccagcggaaguucgacaaccugaccaaggccgagcgcggugggcugaccaacgaggacaaggcccgguucauccagcgccagcucguggagacccggcaaaucacgaagcacguggcgcgcaugcuggacacccguuucaacaccaagcuggacgaggccggcaaccguauccgggaccccaagguaaauaucaucacccucaagagcaaccuggugucccaguuccgcaaggacuaccagcuguacaagauccgggagaucaacaacuaccaccacgcccacgacgccuacaucaacgccguggucgcgacggcccuccugaagaaguacccgcagcuggcccccgaguucguuuacggugaguaucccaccuacaacagcuacaacucccgcaagagcgcaaccgagaaggugcuguucuacuccaacaucaugaacuucuucaagcggaucgucgugcacagcaagaccggcgaggugcgcauccgccccgucaucgaggugaauaaagagacgggggagaucgugugggacaagaaguccgacuuccggaccguccgcaaggugcugagcuacccccaggugaacgucguaaagaagaccgaggugcagaaccauggcuuggaccggggcaagcccaagggguucuacaacgcgaaccucuccccgcgccccaaggagggcagcgucgagaaccuggugccggccaagcagucuuucgacaccaagcgguacgggggcuacgccgggaucagcaacagcuacgcugugcuggucaacggcaucaucgagaagggcaagaagaaguccaaggccgaagugacggaguuccaggggaucagcauccucgcgcgcaaggacuucgacaaaaaccccaagcaguaccugcugaaccucggcuacaaggacaucaaguccaucaucaagcugcccaaguacagccuguucgagcucgagaacgggucccggcgcaugcuggccagcauccuguccaccaacaacaagcggggcgagauccacaaggggaacgagauguaccucccggacaaguucgugacgcugcuguaccacgccaugcgcgucaaccggacccucgagcccggccacaagaaguauguggagacgcaccgccacguguucgacgagcuguugaucuacauccucgaguacaacgagaagaucgucggcgccaaggccaacgggaagcggaucgucgaggcguacagcgcccgcaaggacaccgacaaccuggaggagcugugcaacuccuucaucaaccuccugaaccugaccgcccucgggagcgccguggacuucgaguuccuggggaccaagaucccccgguaccgcgacuacacgcccuccagccugcucaaggccacccugauccaccaauccgucacgggccuguacgagaccaggaucgaccucagcaagcucggaggcgacuga

SEQ ID NO: 7850 - RNA, 4146 nt, Artificial Sequence
  Cas9 variant
augaacuacguaaaggaauaucacaucggucucgacaucggcaccuccucaaucgguugggcagugaccgacucacaguucaagcugaugcgaauaaaaggcaagaccgccaucggaguucgguuguucgaagaagggaagacagccgcagaaaggcgcacauuucgcacuacacgccgccgacuuaaaaggagaaaauggcgccuccacuaccuggacgaaaucuucgcaccacaucuccaagaggucgacgagaauuuucuacgaagguugaaacagagcaacauccacccggaagacccggccaaaaaccaagcauucaucggaaaacuccucuuucccgaucuccucaagaaaaacgaacgcggauacccuacccucauuaaaaugcgcgacgagcuacccguagaacagcgggcccacuacccgguuaccaacauauacaaacugcgugaagcgaugaucaacgaggacaggcaauuugaccuccgagaagucuaccuggcuguccaccacaucgucaaauaccgaggccacuucuuaaacaacgcauccgucgauaaauucaaagucggccgaaucgacuuugacaagucguucaacguacucaaugaagccuacgaagaacugcaaaauggagaaggaucguucaccaucgaacccagcaaagucgagaaaauaggacagcuccuccucgacaccaagaugagaaaacucgaccgccaaaaggccguugcgaaauucuuagaagucaagguggccgacaaagaagaaaccaaaaggaacaaacaaauagcaacugccaucucaaaacucgugcucggguacaaagccgacuucgcgacggucgcaauggccaacggcaacgaguggaaaauagaccucagcucagagacgucagaagacgaaauagaaaaguuccgagaggaacucagcgacgcacagaaugacauccucacagagauaacgucacuguucagucaaaucauguugaacgaaaucguaccuaauggaaugagcauaagcgagucaaugauggacagguacuggacccacgaacgacaauuggcggaggucaaagaguaccucgccacccaacccgccagcgcacggaaggaguucgaccaagucuacaacaaauacauaggucaagccccaaaggaaaagggcuucgaccuagaaaaaggacuaaagaaaauacucuccaagaaagaaaacuggaaagaaaucgacgaacuccuaaaagccggcgacuuccucccaaaacagcgcaccagcgcgaacgucgucaucccacaccagaugcaccagcaagaacucgaccgcauaauugaaaaacaagccaaauacuaucccuggcucgcaacagaaaauccugcgacuggagaacgggaucgucaccaggcuaaauacgaacucgaccagcuagugaguuuccgaaucccguacuacguuggaccccuaguaacacccgaaguccaaaaagcgaccaguggggcaaaguucgccugggccaaaagaaaagaagacggcgaaaucaccccguggaacuuaugggacaaaauagaccgagcagaaucggcggaagccuuuaucaaacguaugacagucaaagacacguaccuauuaaacgaagacguucuaccugcgaacagccuacucuaccagaaauacaacguccugaacgaacucaacaacguacgagucaacgggcgccgccucucaguaggaaucaaacaagacaucuacucagaacuuuucaaaaagaagaaaacaguaaaagcgagcgacguagccucccucgugauggcgaaaacacgaggagucaacaaaccgagcguggaaggcuuauccgacccgaaaaaguucaacuccaaccucgcaaccuaucucgaccuaaaguccauaguaggcgacaaaguggaugacaacugcuaccaaacagaccuagagaacauaaucgaauggagguccguauucgaagacggcgaaauauucgccgacaaacuaaccgagguugaauggcucaccgacgaacaacgcuccgccuuagucaagaagagauacaaagggugggggagacucagcaagaaauuacuaacuggcaucguagacgagaacggccagcgcauaauagauuuaauguggaacaccgaccaaaacuucaugcaaauuguuaaccagccaguauucaaagagcaaauagaccaacuaaaccaaaacgccaucaccaacgacggcaugacccuacgagagagggucgaaucgguacucgacgacgcauacacauccccacaaaacaagaaagcaaucuggcaaguaguccgugucguagaggauaucgucaaagcggucgggaacgcaccaaaauccauuucaaucgaguucgcaaggaacgaagguaacaaaggcgaaauaacgagaucucgacggacgcaacuccagaaacuguucgaggaccaagcacacgagcucguuaaagauacaagccucaccgaggaauuggaaaaagcgcuugaccuauccgacagguacuacuuauacuucacacagggcggaaaagacauguauacgggcgacccgaucaacuucgaugagaucagcacaaaauacgacauagaccacauccuaccccaguccuucguuaaagacgacucccucgauaacagaguccuaguaagccgggccgaaaauaacaaaaaguccgacaggguaccggcaaaacucuacgccgccaaaaugaaaccauacuggaaccaacuccucaaacagggccuaauuacacaacgaaaauucgagaaucuuaccauggacgucgaccagaacauaaaguacagaagccuaggcuucgucaaacgccagcuaguagagacccgacaagugaucaaacuaacggccaacauccucggcuccauguaccaagaagcagggacagacaucauagaaacacgcgcaggacuaacgaaacaacuccgggaggaguucgaccugcccaaaguacgcgaaguaaacgacuaccaccacgccguagacgccuaccucacgaccuucgccggucaauaccucaaucggcgcuacccaaaacuccguucauucuucguuuacggcgaauacaugaaguuuaaacgcggcagugaccuuaagcugcgcaacuucaacuucuuccacgagcucauggaaggagacaagucacaaggaaaggugguggaccaacaaacgggggaacugauaaccacacgcgaugaagucgcaaaaucauucgaccgguuacuaaauaugaaauacaugcuagucuccaaggaaguccacgaccgguccgaccaacuauacggcgcaaccauagugaccgcgaaggagagcgggaaacuaacaucacccaucgaaaucaagaaaaaccgccccguagaccucuacggagcauacaccaacggaacauccgccuucaugacgaucauaaaauucaccggcaacaagccgaaauacaagguaaucggcguccccaccaccuccgccguaggccuaaaacggguaggcaagccaggcucagaaagcuacaaccaagagcuacaccgcaucauaaaauccaaccccaaaguaaagaaagacuucgaaaucguggucccccacguguccuacagccaacucauuguggacggagacugcaaguucacgcuagcauccgacacauaccaacacccggcaacacagcucguccuauccaaagaaagcauggagauaauagccgacgacuucaaguucguaaaagagaauccagccacagccgacgagcaacucgugcgggucuucgacgaaaucguaaaccagaugaaccacuacuucacgaucuucgaucaacgauccaaccgacaaaaagucacgaaagcucgcgauaaguucguaucacugcccacggaaucagaguacgagggugcaaagaaaacgcaagucggcaaaacggaaguaaucacgaaccuacuaaugggccugcacgccaacgcagcccaaggcgaccucaaaguccucggacuauccacguucggauucuuccaaucaucgggaggacucaaucuaucggaagaugcaaugauaguauaccaguccccaaccggccuauucgaaaggcgcaucugccucaaagacaucuga

SEQ ID NO: 7851 - RNA, 4146 nt, Artificial Sequence
  Cas9 variant
augaagcagauccugaagaaggugcagggguacaacauagggcucgacaucgguaccaacagcgucggcuggguggugacagacgagaacgccaaccugcugcaauuccgcaagaagaauauguggggcgcacgccucuucgagaaaggggacacggcgcagggccggcggcuuucgcgcaguacccgccgccgguacgaccgucggcgccagcggauccacuaccugcaggagaugcucgccaccaugguccugccaaucgacgaguccuuuuucauccgccugaacgaggcuuuccucuggaaggaggacaagagcgugcagcgggacuacauccuguucgcugacaagcaguucaccgaccgcgacuucuacaagcaguucaaaacgaucuaucaccugaggaaguuccuccuggacaccaaggagaaggcggacccgcgcuucauuuaccuggcgcuacaccacaugaucaaguaucggggcaacuuccuguaccaggggcaauccuucgacguggucgagaacgugcaagagagcuuccgcgugcugcucgaggagauguacgagcaguuaggcaaagagugggaguacggggagcacuucgaugacauccagcggauccucgagaauaccaccaucggcaagaaguccaagcaggagcagaucgccgccauccucacugagcaguacgggaacaagaagcuggccaacgaggucacccgcgcgugcuugggcuacagcuuugaccucaccgugguuauggagaacgagaaccugcuggacgaguccggcaagaaaaucaagaucagcuucagugacagcaaauacgaggagcaggagcucgaacugcagaaucggcuagaggagaaguuugcugucaucgaggcccucaaacggaucuacaacugguuagugcugaaggauacccuccgcggcaagaaauacaucucagaggccaugguuaacaaguacgaggcccaccacgaagaccuggucaaguuaaagcgccuauucagaacguaccugagcaccgaggaguacucuugcuucuuccgaaaggagaagcagaaggacaaguacauaagcaauuacgugaacuaucgcaagggagcggagcggugcuccaaggaaaagcuguacaaggccauccacgagcuguucgacacaguggccaaggaugacguuguguaccaagagaucguggagaaaauggaccagggggaguuccugaccaagcagaacgaggucagcaacgccuacauccccuaccaaugcaacgaggucgagaugaagcgcauacugaagcagcagggcgaguucuaccccgagcucaaggagaacgcagauaagauccugcaguuacuccuguucaggauccccuacuacgugggcccccugguugacgaaaagcagaguaaauucgcguggaugaagcgccggacggggauggaacaggucaagaucuacccuuggaacuucgagcaagucgucgacaucgaccagacggccgaagccuuuaucacccgcaugaccaacuacugcacguaccuccccgaggagaaggugcugcccaagcagagccucuuguacagcgaguacgagcuccugcaggagcugaacaagaucaagaucaacggcaaguucucgcucgagacccguaacaagauaaucgaacagcuguucaagaagcagaagaaagugaccgagaaacagcugaagaaguggcuggugcgcgagcaguauugcacaacgaagguaaccgagaagauggucaagcuggaugaaaacgccuacuacaucaccggguuucagaaggagaacgaguucgccagcucccugacuagcuacaucgauuucacgaagauccucggcgagaucaccgaacggaaccgcaagaugaucgaggagaucaucuacuggcugaccguguuugaggagaaguccaucgugaagcggaagauacagaaaaaguacggaaacgagaucaacgacaagcagcuggcccagaucuugaagcugaacuacagcggcuggggaagguucucugagaaguuccugaacggcaucaagggcuucgaccggcaggggcagaaaaagaccauuauggagcuccugcgcgaggacagccggcugcuuaacaucaugcagauaaucaacaacgaggagaugggcuucuguaagaucaucgaggccaaccagaagaagcuauacgggaacgaaaaccuguuagacgucgugcaggaacugcacggcaguccggccaucaaacgcggcaucuggcagagccugaagaucguggaagagaucaucuccaucaugggcggggucccucagaacaucuucaucgaguucgcacgcgaggacgacgaccgggugcgcacgaacagccggguaaagcagaucgagcgguuguacaagaaguucaaggaggaggucaacgacuucaacgagcacgcggcgaacgagcugaaggagaagcgguaccagaaccgcaucgacgaggagaagguguuucuguacuucaugcagaacgggaagucccucuauagcggcgugacacuggacaucgaccggcugaacgaguacgaggucgaccacauuauuccccgcacccucgugaaggaugacucacuggagaacaaggcccucgugcucaagggggagaaccaacggaaaggcgagggccugaucccgcacgaauggcagaaccgacagaaggaggucuggaagaaguugcucuccugcgggcugaugggcaagaagaaguacgccaaccugugcaaggaguccuucgggaacgagaaggagcaaaagcacuuuaucgcacggcagaucguggagacucggcagaucaucaagcaggucgcgaacauuuuagcccaguacuaccagggcgugaacguugccgccgucaaggcuagccugggcuccgagcugcgggagaacuacacgaucgagaaaaaggacgacaacggcuuuuucauggagaacaagagcuauaccaugcucaagagcagaaagaucaacgacuuccaucacgcgcaggacgccuaccuggccugcgccgucggucuguacaucaaggccgcguucccgaaguacgagaaggagaucgacuacgagggcuaccggaaguacuaccagaagaagaaccaacagaaggacggcgugcgcaacgagaagcggcaguucuucuccuacgugaugagccgcuucuccgagcaaaucgucgacaaggagaccggggagaucuugugggacggcacccagaagcuggccuacaucaagaaaaucuucggcuaucgggacugccugaucaccaagaagcuggaggagaacacgggcgaguucuacaagcagaccaucaacgccaagccagagaagggcaaggaaaacaacaccaagcugcugccuauaaagaaggggcuuagcguggagaaguacggcggguaccagggcggcgaggcugccuacuccugccuggugcgcuaccagcaagggcgaaagacaaaacugucauuggagaaaaucuccgucauuaucgcgaagaagaucgccgaaaaagaagugagcuuggaccgcuaccugaaggagaaguugggcguggaagagaucgucauccuacgcaagaaggugaugaagaaccagcugaucgaggacuccgaugggaaucgguucuaccuaacggcggccaccgagguggugaaugcgaagcaguucauccuggacggcaagcaccaacacuugcuucgcaccauagccauaauggagaaaggagaguacuauggcuacaggcuggacgagcuggagaacagcauggacgaguuauaugccuacuaccgcaugaagauccaacaacaguaccccgccuaugagagcaucgugaagaagaucguggagagccacguuuacgaaucacuucacgucgaggagaagauuaaggccgugcaagagaagggcaaguucuugauccaguuacugcggcugaccgaagcgaacgccgagugcauugaucucaagacgaucagcgacgggcgcuuggccgaccggaucggccgcaagaaccacuacaccauaaaagaggggaucaaguucauagaucaguccaucaccggccuguaugagcgguacaugaccgucuga

SEQ ID NO: 7852 - RNA, 4146 nt, Artificial Sequence
  Cas9 variant
auggacuacgugaaggaguaccacaucggccuggacaucgggacgaguuccaucggcugggccgucaccgacagccaguucaagcucaugcgcaucaaggggaaaacagccaucggcgugcgacuguucgaggaggggaagaccgcggccgagcgccggaccuuccgcaccacgcggcgccggcugaagcgacguaaguggcgccuccacuaccuggacaaaaucuuugcaccccaccuccaggagguggacgaaaacuuccuccgucgccugaaacaguccaacauccaccccgaggaccccgcgaagaaccaggcguucaucgguaagcuccucuuucccgaccugcugaagaagaacgaacggggcuaccccacccucaucaagaugcgcgacgagcugccggucgagcagcgggcccacuaucccgugaccaacaucuacaagcugcgcgaggccaugauuaaugaggacagacaguucgaccuccgcgagguguaccuggccguccaccacaucguuaaguaccgggggcauuuucugaacaacgccagcguggacaaauucaaggucggccguauugacuucgacaaguccuucaacgugcucaacgaggcguacgaggaacugcagaacggggagggcagcuucaccaucgagccauccaagguagaaaagaucggacagcugcucuuggacacuaagaugcggaagcuggaccgccagaaggccgucgccaagcuccuggaggugaagguggccgacaaggaggagaccaagcgcaacaagcagaucgccaccgcgaugagcaagcugguacuuggcuacaaggccgacuucgccaccguugccauggccaaugggaacgaguggaagaucgacuugagcagcgagaccuccgaggacgagaucgagaaguuccgggaggagcugucugacgcgcagaacgacauccucaccgagaucaccucccuguucagccagaucaugcucaacgccaucgugccgaacggaauguccaucagcgaguccaugauggaccgcuauuggacucacgaacggcagcucgcggaggucaaggaguaccuggcgacgcagccggccagcgcgcgcaaggaguucgaucaaguguacaacaaguacaucggacagguacccaaggaaaagggguucgaccuggagaagggccucaagaagauacuguccaagaaggagaacuggaaggagaucgacgagcugcucaaggccggcgauuuccugcccaagcagcggaccagcgcgaacggugucaucccccaccagaugcaccagcaggagcuggaccgcaucaucgaaaaacaagccaaguacuacccguggcucgccaccgagaaccccgcgaccggcgagcgggacagacaccaggccaaguacgagcuggaccagcuggugagcuuccggauccccuacuaugugggucccuuagucacgccggagguacagaaggccacauccggcgccaaguucgcgugggcuaagcggaaggaggauggggagaucacccccuggaaccugugggacaaaaucgaccgggccgagucugccgaggccuucaucaagcgcaugacagugaaggacacguaccugcucaacgaagacgugcugcccgcgaacucccugcuguaccagaaauacaaugugcucaacgagcugaauaauguccgggugaacggccgccggcugagcgugggcaucaagcaggauaucuacacggagcuauuuaagaagaagaagaccgucaaggccggggacguggccucccugguuauggccaaaacacgcggcgugaauaagcccagcguagaggggcuguccgacccaaagaaguucaacagcaaccucgccacguaccuggaccugaaguccaucaugggcgacaaaguggacgacaaucgguaccagauggaccucgagaauaucaucgaguggcgcagugucuucgaggacggggagaucuucgcggacaagcucacagaggucgaguggcugaccgacgagcagcgguccgcccucgugaagaagcgcuacaaggguuggggcagacugagcaagaagcugcucaccgggauugucgacgaaaauggccagcgcaucaucgaucugauguggaacacggaccagaacuucaugcagaucgugaaucagcccguguucaaggagcagaucgaccaguuaaaccagaaggcaaucaccaaugacgggaugacccuccgcgagcgagucgaguccgugcuggacgacgccuacaccagcccccagaacaagaaggccaucuggcaggucgugagagugguugaagauaucgucaaggcgguggguaacgcccccaaguccaucagcaucgaguucgcccggaaugaagggaacaagggcgagaucacacgcucccggcgcacccagcugcagaagcuguucgaagaccaggcccacgaguuagugaaagacaccaguuuaaccgaggagcucgagaaagcgccagaccuguccgaccgguauuauuucuacuucacccagggcgggaaagacauguacacgggcgaccccaucaacuucgacgagaucagcaccaaguacgacaucgaccacauccugccucagagcuucgucaaagacgacucccucgacaaccgcguguuggugagccgggcugaaaacaacaagaaguccgacaggguccccgccaagcuguacgcggcuaagaugaagccguacuggaaccagcuccugaagcagggacugaucacccagcggaaguucgagaaccucaccauggacgucgaccagaacaucaaguaccgcagucugggcuucgugaagcggcaguugguggagacaaggcagguaaucaagcucaccgcgaacauccugggcucaauguaccaggaagccgggacugacaucaucgagacccgggccggccugacgaagcaguugcgcgaggaguuugaccugccuaaggugcgggaggucaacgacuaccaccacgccguggacgccuaucuaaccaccuuugcagggcaguaccucaaccgccgguaccccaagcuccgcagcuuuuucguguacggcgaguacaugaaguucaagcacgguagcgaccugaagcucaggaacuucaauuucuuccaugaguuaauggagggcgacaagagccagggcaaggucguggaccagcagaccggcgagcugaucacgacccgggacgagguggcaaaaucuuucgaccgccuccugaacaugaaguacaugcuggucuccaaggaggugcacgaccgguccgaccagcuauacggugccaccauugugaccgcaaaggagagcgggaagcugacguccccgaucgagaucaagaagaaccguccagucgaccuguacggcgccuacaccaaugggaccagcgcguucaugaccaucaucaaauucacgggcaacaagcccaaguacaaggugaucggcgugcccaccaccuccgccgucggguuaaagcggguugggaaaccggggagcgagucauacaaucaggaguuacaccgcaucaucaagagcaaccccaaggugaaaaaggacuucgagauagucguuccccacgucucguacucccagcuuaucguggauggagauugcaaguucacccucgccagcgacacauaccagcaccccgcaacccagcugguucuguccaaagagagcauggaaaucaucgcagacgauuuuaaauucgucaaggagaaccccgccaccgccgacgagcagcuugugcggguuuucgacgagaucgucaaccagaugaaucacuacuucaccaucuucgaccagagauccaaccggcagaaggugacgaaggcccgcgacaaguucgugagccugcccaccgaguccgaguacgagggugccaagaagacacaggucggcaagaccgaggugaucacgaaucuccucaugggcuugcacgcgaacgcggcccagggggaucugaaagugcucggccugagcaccuucggcuucuuucagucaagcggcgggcugaaccucuccgaagaugccaugaucgucuaccagagccccaccggccuguucgagcggcgcauuugccugaaggacauauga

SEQ ID NO: 7853 - RNA, 4146 nt, Artificial Sequence
  Cas9 variant
augaagaaguccuacgccaucggcaucgacauugggaccaacagcgugggccacugcgucauguacaccgagaacuacaaggugcccagcaagaagaugaagguguucggcaacacggagaagcgcuacaucaagaagaaccugcucggcacccugcuguucgacgaggggaacaccgccgagaaccggcgcuuaaaacggaccgcgcgccggcgcuacacgcggcgccggaaccguauccuguaccugcaggagaucuucgccgaggagaucaacaagaucgacgacuccuucuuccagcggcucgacgacagcuuccugaucgucgaggacaagcagggcuccaagcacccgaucuucggcacccugcaggaggagaaggaguaccacaagcaguuccccaccaucuaccacuuacguaaacagcuggccgauagcucccagaaggccgacauccggcugauuuaccucgcccuggcgcacaucaucaaguaccgcgggcacuuccuguucgagggggaccucaaaagcgagaacaaggacgugcagcaccuguucaacgacuucguggagauguucgacaagaccgucgaggguuccuacuuaagcgagaaccuccccaacguggccgacgugcuggucgagaagguguccaagagccggcgccuggagaacauccuccacuacuuccccaacgagaagaagaacggccuguucgggaacuuccuggcacuggcccugggccugcagccgaacuucaagacuaacuucgagcucgcggaggacgccaaaauccaguucuccaaggagaccuacgaggaggaccuggaggagcugcucgguaagauuggggacgacuacgccgaccuguucaucgccaccaagagccuguacgacggcauccuccuggccgggauccuguccaccacggacagcaccaccaaggcgccccucuccagcuccauggugaaccgguacgaggagcaccagaaggaccuggcccugcuaaaggacuucauccgccagaaccugagcgauagcuacaaggaguucuuuaacgacacccugaaggacggcuacgccggcuacaucgaggggaagacgacccaggagaacuuuuaccgguucaucaagaaggccaucgagaagaucgaaggcuccaacuacuucaucgacaagaucgaccgcgaggacuuccuccggaagcaacgcaccuucgacaacgggagcaucccccaccagauccaccuccaggagaugcacgccaucauccgccggcaggccgaguucuaccccuuccuggucgagaaccaggacaagaucgagaagauccucaccuuccgcaucccguacuacgugggcccccuggcccggggcaagagcgaguucgccuggcugaagcgcaagagcgacgagaagauccggcccuggaacuucgacgagaugguggacaaggagaccuccgccgagaacuucaucacccgcaugaccaacuacgaccaguaccuccccgaccagaagguccugccgaagcacagccugcuguacgagaaguucgccguguacaacgagcucaccaaggugcgguacgucacggagcaggggaaguccuucuucuucgacgcgaacaugaagcaggaaaucuucgacggcguguucaagguguaccgcaaggucaccaaggagaagcugauggacuuccuggggaaggaguucgacgaguuccggaucguggaccucaugggcuuggacaaggacaacaagagcuucaacgccucccuggggaccuaccacgaccucaagaagaucgugagcaaggaccugcuggacaaccccgagaacgaggacauccucgagaacgucgugcugacccugacgcuguucgaggaccgcgagaugauccggaagcgccuggagaaguacaaggacguccugaccgaggagcagcggaagaagcucgagcgccggcacuacaccggcuggggccgcuuguccgccaaacugaucaacggcauccggaacaagaccacgcgcaagaccauccucgacuaccugaucgacgacggcaccagcaaccggaacuucaugcagcugauccacgacgauacccugagcuucguggacgagauccgccuggcccaggggagcggcgaggccgaggacuaccgcacggaggugcagaaccuggcggggucccccgccaucaagaagggcauccuccagagcuugaagaucguggacgaacugaucggcgugaugggcuacaaccccgagcacguggucguggagauggcccgggagaaccaguucaccaaccagggccgccgguccagccagcagcgcuacaagaagaucgagaacgccaucaagaaccucgacuccaaccugaacagcaagauccugaaggaguacccgaccaacaaccaggcgcuccagaacgaccggcuguuccuguacuaccuccagaacgggaaggacauguacaccgacgaggaguuagacaucgaccagcugagccaguacgacauagaccauaucaucccgcaggccuucaucaaggacgacucccucgacaacaaggugcugaccaaaagcgccaagaaucgcggcaaguccgacgacguccccagccuggagaucgugcacaagaagaagaacuucuggaagcagcuccuggacucccagcugaucagccagcggaaguucgacaaccucacgaaggccgagcgcgggggccugaccaacgaggacaaggcccgguucauccagcgccagcugguggagacccggcagauaaccaagcacgucgcgcgcauccucgacacgcgguucaacaccaagcuggacgacgccggcaaccgcauccgggaucccaaggugaacaucaucaccuuaaaguccagccucgugucccaguuccgcaaggacuaccagcuguacaagguccgggagaucaacaacuaccaccacgcccacgacgccuaucugaacgccgugguggccaccgcccuccucaagaaguacccgcagcuggcccccgaguucgucuacggggacuaccccaaguacaauagcuacaagagcaggaaaagcgccacggagcgggugcuguucuacaguaacaucaugaacuucuucaagcgcguggucaagagcuccaagaccggaaccgugaagauacggcccaucaucgaggugaacaaggagaccggggagaucgucugggacaagaaguccgacuuccgcacggugcguaaggugcugagcuacccgcaggucaacguggugaagaaaacggagguccagaaccacggccuggaccgggggaagcccaagggcuucuacaacgccaaccucagcccccgccccaaggaagguagcguggagaaccuggugccggcgaagcaguccuucgacaccaagcgguacgggggcuacgcagggaucagcaacuccuacgccguccuggugaacggcaucaucgagaaggggaagaagaaguccaaggccgaggugaccgaguuccagggcaucagcauccucgcgcgcaaagacuucgagaagaaccccaaacaguaccugcugaaccucggcuacaaggacaucaagagcaucauaaagcugcccaaguacucccuguucgagcucgagaacgggagccgacgcaugcuggccuccauccugagcacgaacaacaagcggggcgagauccacaaggggaacgagauguacuugccggacaaguucgucacccugcuguaccacgccaugcgcgugaaccggacucucgaacccggccacaagaaguacguggagacccaccgccacgucuucgacgagcugcugacguacauccucgaguauaacgagaaaaucgugggggccaaggccaacggcaagcgaaucguggaggcguacuccgcccgcaaggacaccgacaaccuggaggagcugugcaauagcuucaucaaccuccugaaccugaccgcccucggaagcgccgucgacuucgaguuccuggggaccaagaucccccgguaccgcgacuacacgcccagcucccugcucaaagccacccuaauccaccaaagcgugaccggccuguacgagacccggaucgaucucuccaagcucgggggcgacuga

SEQ ID NO: 7854 - RNA, 4146 nt, Artificial Sequence
  Cas9 variant
augaagaagaucaucggguuagaucucggcacgacauccauuggcugggcguauguccacgaggcagaaagugcccaagagcgcucagaaaucgucagacuaggagcucgagucgugccccugacaaccgacgaacaggaugaguucaagaaaggcaaaagcauaacgacgaacgcagccagauuaucaaagcgcucccuccgaagaaacgcggacagguuccagcuuagacgcgaugaacucgcaggggugaugaaagaagccggguggauagacgaaacaacaguccucgccgaacagggacccagaagcacauucgaaacacuccgcuugcgggcaaaagcagcaagcgaagaggugacacucgccgaguucgccagaauacuccuucagaucaaccgcaaaaggggguacaaauccaaucgcaaaacagacggcgacgaagaaggagcacugauugacgguauggacguaagcaagcaacugaacgcaagcggccaaacacccggcgaauggguguuagccagaaugcaggagggaaacgcagugaucccagccuuuuacugcagcgacuuaagcgaggaguuggacagaaucuggaggaaacaacaagccagucaccaagcauggaugaccgaggaacuccacacaguacuacgacacgcggacggaaggagugccauacgccugauggacaaagcaggaguagucccagacagcgucaacgugaaagaacgaagaagaguuauguacgaauggcgcgcggccgcaguccgggacugucuccccgccgggcgaguugcagccgcccuaaugcaagugucaaaggagaucggacgggcugacucauacuugggucgaaucggggacaggagcaaggaacucuacuuccaccgacagacagucggccaguaccucuggaggcuaauaugcgacaaccccaaccagucacugaaaaaccuagucuucuaccgacaagacuaucaacacgaguucgaaacccuauggucgauccagacaaaguaccaugucgaacucacugaagaccucagaaaacgagucggccgaauaauauucuuccagcggccccucaaauccaagaagggccuggucaaccggugcgagcuaguacacuacucagucugcgaaaacagcggggacgacuuaaccgaaaaaguugacguagggccaaaaguaugcccgaaaucuucaccccucuuccaggaguuuaaagucuggcaaguacucaauaauguagaaguuauccacccguccacacaggaggcacgcaggcucgagauggaagagaaagaacuacucgcgagugagcuuuuguucagggaccgcaugaagaaaaucgacguccuaaaacuccucuucagcaacuggcgagaccuagaccucaacuauaaggaacuugaagggaacagaacuauggccgcauucuaccguguauacgaacaagugaucgcgcagaccggacauggggacuacgauuucgccaaaaugagagcugcgaaggucaaggaacuagccgaaggaguauucgccggccucggcuucgaagucggacuccucacguucgacgccgaacuggacaguccagcauacgaacaacagccaugcuaccgacuauggcaccuauuauauagcuacgaaggugauaaguccgcaaccggaaauaaaugccuauugaagaaacugugcagacugacaggaaugaacgcagagcucgugggccuauucaugcagauuagauucagcggggacuacggaucacuaagcacgaaagccaugaggcggauacugccuuaccucaaagcgggcaacaccuaugacgucgccugcgaguacgcaggcuucagacacagugcccggagccuaacccgcgaggaacuggcucagaaagaguacaaagauuaccucgaccuauuaccgcggaacucacuacgcaaccccguagucgaaaagauacuaaaccaaaugauacacguaguaaacggccuaucauccacguacggcaaaccagacgaaauaagaguagaaauggcaagggaacucaagaaaagcgcacgcgagcgggaagaaaugacaagcgcaauaucaaagaccaccaaagaaaaugcagaaaucacugcaauccugcaaagagacuucggacuaagauacguaagcagaaacgacauauuacgcuauaaacuauacugcgaacuaagaauaaaaggcaacggaugcagaacgcuguauagcaacacguauaucaaucccaacgaacuuuucagcagagaguucgacauagaacacaucaucccccagucccgucuauucgacgacagcuucucuaacaagacccucgagucacgaaccgcaaaccuggagaaaggagacagaaccgcgugggacuacgugaacgagaaauacggagcggaacgagccgacgaauaccgugcccaaguggaggcuuuguaccgggacggcacgauaucaaaagcaaagcgcgacaagcuccuaaugccaggcgacaaaauccccgaagacuucaucgauagagacaucagaaacacacaauauauagcaaagaaagcccucgaaaucuucgaagauuucgucccgagcgugguagcaacgucgggcaacguuacagcacgccucagagaagacuggggacuuguggacguaaugaaagaacuuaacuggagcaaauacgaaucucagggaauggugcacauagaauacgaccgagacggaagaccaauccgccgaauaguagacuggaccaaacgcaacgaccaccgucaccaugcaauggacgcccuggcaguggcauucacuaaacgguccuacauacaauaccuaaaccaucuaaacgcccggaaggaggcgacaagcguagcguacgccauacaacacaaagagauggaacuggaugggaguaauagauggcgcuucaaaugccccuuuggcgaccgcagcgcuuucagacgggaggccaaagcacaacuagagcggauucuaguaucgaucaaauccaagaacaaaguccuaacccccagugucaaucgaacaaagaaacgaggagguuucaauaagaagguagaguggacccccagaggggcacugcacaacgagaccguauacggcaggauccggcgcuacgacguaaaagagcuacgcgugggaagcucauucacugcagaggugaucggaaaaguggccgacagcagauaccgggcugcucucaugcacagacucgcugaguucgggggcgaccccaaaaaggccuuuacggguaaaaauucauuagagaaaaacccgcucuauacagaugaagcacacacagcuugcguccccagcucgguaaagguagucagcuucguagaaaucgggacgauccgaaagggaguagaccccaaccucaacguugacaaagucguggacacccacaucaagaacauccugcuagcacgucugucggcauacgggggcgacgcaaagaaggcauucaguaaccuggaugccgacccgaucuggcuaaacaaggaaaaagggaucgcgauaaaaagagucacgaucucggacgacuccgagguccggccaauacacgucaaacgcgacaugagaggcaggcuuguaugugacgaacacggacgaccggucccaucggacuacguacagcucagaaacaaucaccacgucgccauauucagggacgccaauggggagcucaaagagcgagucgucacauucuucgaagcggucgaacgggucagacaacugcgcuccgaaggccgggcggucgaagucaucgacaagaacuacaagugcgaagaaggguggaccuuccucuucuccaugaaaaucaaugaauacuucgucuuuccggacgccgcuucaggauucgaccccagagaaaucgaccuaacagauccagcaaacuacgcacugauaagcccccacuuauuucgaguacagaaacuuucaucaaaggacuacuacuuccggcaccaccuagagaccacgguaaacgacguaaagcaacuacgcgacauaacauggaagcgcaucagcucgcuccaagaucuugccggaacgguaaaaguccgcguaaaccacauagggcaaaucgucgcgguaggagaauauuga

SEQ ID NO: 7855 - RNA, 4146 nt, Artificial Sequence
  Cas9 variant
auggugaagaagaaguacgccaucggcaucgacaucgggaccaacagcgucggcugguccaucgugaccgacgacuacaaggugcccagcaagaagaugaaggucuucgggaacacggagaagcgcuacaucaagaagaaccugcucggcaccuugcuguucgacgaggggaacaccgccgagaaccggcgccucaagcggaccgcgcgacggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccauaagcaguuccccaccaucuaccacuugcgcaagcagcuggccgacagcucccagaaggccgacauccggcugaucuaucucgcccuggcgcacaucaucaaguaccgcggacacuuccuguucgagggcgaccucaagagcgagaacaaggacgugcagcaccuguucaacgacuucgucgagauguucgacaagaccguggagggguccuaccugucggagaaccuccccaacguggccgacguccugguggagaaggucuccaagagccggcgccuggagaacauccuccacuacuuccccaacgagaagaagaacggccuguucgggaacuuccuggcccucgcacugggccuacagccgaacuucaagacgaacuucgagcucgcggaggacgccaagauccaguucaguaaggagaccuacgaggaggaccuggaggagcugcucggcaagaucggggacgacuacgccgaccuguucaucgccaccaagagccuguacgacggcauccuccuggccgggauccuguccaccacggacagcaccaccaaagcgccucucuccagcuccauggucaaccgguacgaggagcaucagaaggaccuggcccugcucaagaacuuuauccaccagaaccugagcgacagcuacaaggagguguucaacgacaagcugaaggacggcuacgccggcuacaucgaggggaaaaccacgcaggagaacuucuaccgcuucaucaagaaggccaucgagaagaucgagggcuccaacuacuucaucgacaagaucgaccgggaggauuuccuccgcaagcagcggaccuucgacaacgggagcaucccccaccagauccaccuucaggagaugcaugccaucauccgcagacaggcggaguucuaccccuuccugguagagaaccaggacaagaucgagaagauccucaccuuccggaucccguacuacgucggcccccuggcccgcgggaaguccgaguucgcauggcugaaccggaaauccgacgagaagauccgccccuggaacuucgacgaaaugguggacaaggagaccuccgccgagaacuucaucacgcggaugaccaacuacgaccaguaccuccccgaccagaaggugcucccgaagcacagccugcuguaugagaaguucgcagucuacaacgagcucaccaaggugcgcuacgugacggagcagggcaaguccuucuucuucgacgcgaacaugaagcaggagaucuucgaccggacguucaaagucuaccgcaaggugaccaaggagaagcugauggacuuccugagcaaggaguucgacgaguuccggaucguggaccuccugggccuggacaaggacaacaagucguucaacgccagccucgggaccuaccacgaccuuaagaagaucgucuccgaggacuuccuggacaacagcgagaacgaggacauacuagagaacgugguccugacccugacgcuguucgaggaccgcgagaugauccggaagcgcuuggagaaguacaaggacgugcugaccgaggagcagcggaagaagcucgagcgccggcacuacaccggaugggggcgacuauccgccaagcugaucaacggcauucgggacaaggugacccgcaagacgauccucgacuaccugaucgacgacgggaccagcaaccggaacuucaugcagcugaucaacgacgacacccucuccuucgucgacgagauccgccuggcccagggcagcggcaaggccgaagacuaccgcgcggagguacagaaccucgccgggucccccgcuaucaagaagggcauccuccagagccugaagaucguggacgagcugaucgaggucaugggguaugaccccgagcacaucgugguggagauggcccgggagaaccaguucaccaaccagggccgccggaacucccagcagcgcuacaagaagaucgagaacgcgaucaagaaccucgacagcaaucugaacagcaagauccugaaggaguaccccacgaacaaccaggcccuccagaacgaccggcuguuccuguacuaccuccagaacgggaaggauauguacaccgacgaggaacuggacaucgaccagcugagucaguacgacaucgaccacaucaucccgcaggccuucaucaaggacgacucgcucgacaacaagguucugaccaaguccgccaagaaccgcggcaagagcgacgacgugcccucacuggagaucguauacaagaagaagaacuucuggcagcagcuccuggacucucagcugaucucccagcggaaguucgacaaccucaccaaagccgagcgcggcgggcugaccaacgaggacaaggcgcguuucauccagcgucagcuggucgagacgcggcagaucaccaagcacguggcccgcauccucgacacccgguucaacaccaagcuggacgaggccggcaaccgcauccgggaccccaaagugaacaucaucaucuuaaagagcaaccucgucucccaguuccgcaaggacuaucagcuuuacaagguacgggagaucaacaacuaccaccacgcccacgacgccuaccugaacgcgguggucgccacggcccuccuuaagaaguacccccagcuggccccggaguucguguacggggaguaccccaccuacaacagcuacaacuccagaaagagcgccaccgagaaggugcuguucuacuccaauaucaugaacuucuucaagcggauugucguucacagcaagacuggcgaggugcgcauccggcccgucaucgaggugaacaaggagacgggcgagaucgugugggacaagaaguccaacuuccgcaccguccgcaaggugcugagcuacccccaggugaacgucgugaagaagaccgaggugcagaaccacgggcuggaccggggcaagccgaagggguucuacaacgcgaaccucagcccccgccccaaggagggcagcgucgagaaccuggugcccgccaagcagagcuucgacaccaagcgauacgggggcuacgccggcaucuccaacagcuacgccgugcuggucaacgggaucauagagaagggcaagaagaaguccaaggcggaggugacggaguuucaggggaucagcauccucgcccgcaaggacuucgacaagaacccgaagcaauaccugcugaaccucggauacaaggacaucaaguccaucaucaagcugcccaaguacagccuguucgagcucgagaacgggucccggcggaugcuggcaagcauccuguccaccaacaacaagcggggcgagauccacaagggcaacgagauguaccuccccgacaaguucgugacucugcuguaccacgccaugcgcgucaaccggacccucgagccggggcacaagaaguacguggaggcccacagacacguguucgacgagcugcugacguacauccucgaguacaaugagaagaucgucggagcgaaggccaacgggaagcggaucguggaggccuacagcgcccgcaaggacaccgacaaccuggaggagcugugcaacuccuucaucaaccuccugaaccugaccgcccucggaagcgcgguggacuucgaguuccuggggaccaagaucccccgguaccgcgacuacacgcccuccagccugcucaaggccacccugauccaccaguccgucaccggccuguacgagacccggaucgaccucagcaagcugggcggggacuga

SEQ ID NO: 7856 - RNA, 4146 nt, Artificial Sequence; identical to SEQ ID NO: 2056
  Cas9 variant

SEQ ID NO: 7857 - RNA, 4146 nt, Artificial Sequence
  Cas9 variant
auggugaagaaaaaguacgccaucggcaucgauaucggaaccaacagcguaggcugguccguggugacugacgacuacaagguacccagcaagaagaugaagguguucgggaacacggagaagcgcuacaucaagaagaaccugcucgggacacugcuguucgacgaggggaauaccgccgagaaccggcgccucaagcggaccgcgcgccggcgcuacacgcggcgccggaaccgcauccuguaccugcaggagaucuucgccgaggagaucaacaagaucgacgacuccuucuuccagcgccucgacgacagcuuccugaucguggaggacaagcagggcuccaagcacccgaucuucggcacccugcaggaggagaaggaguaccacaagcaguuccccaccaucuaccaccuccgcaagcagcuggcagauagcucccagaaggccgacauccggcugaucuacuuggcccuggcgcacaucauuaaguaccgcggacacuuccuguucgagggcgaccucaagagcgagaacaaggacguccagcaccuguucaacgacuucguggagauguucgacaagaccguggagggguccuaccugagcgagaaccuccccaacgucgccgacgugcugguggagaaggucuccaagagccggcaccuggagaacauccuccacuacuuccccaacgagaagaagaacggccuguucgggaacuuccuggcgcucgcccugggccugcagccgaacuucaagacgaacuucgagcucgccgaggacgccaaaauucaauucuccaaggagaccuacgaggaggaccuggaggagcugcucggcaagaucggggacgacuacgccgaccuguucaucgccaccaagagccuguacgacggcauccuccucgccgggauccuguccaccacgaacagcacgaccaaggcgccccucuccagcuccauggugaaucgcuacgaggaacaccagaaggaccuggcccugcucaagaauuucauccaccagaaccugagcgacagcuacaaggagguguucaaugacaagcugaaggacggcuacgcaggcuacaucgaggggaagaccacgcaggagaauuucuaccgguucaucaagaaggcaaucgagaagaucgacggcuccaacuacuucaucgagaagaucgagcgcgaggacuuccuccggaagcagcgcaccuucgacaacgggagcaucccacaccagauccaccuccaggagaugcaggcgaucauccggcgccaggcgaaguucuacccguuccuggaggagaaccaggacaagaucgagaagauccucacauuccgcaucccguacuacgucggcccccuggcccgggggaaaagcgaguucgccuggcugaaucgcaaaagcgacgagaagauccggcccuggaacuucgacgagaugguggacaaggagaccuccgcuaagaauuucaucacgcgcaugaccaacuacgaccaguaccuccccgaccagaaggugcugccgaagcacagccugcuguacgagaaguucgccgucuacaacgagcucaccaaggugcgguacguaaccgagcagggcaaguccuucuucuucgacgcgaacaugaagcaggagaucuucgacggcgucuucaagguguaccgcaaggugacgaaggagaagcugauggacuuccuggggaaggaguucgacgaguuccggaucgucgaccuccugggccuggacaaggagaacaagagcuucaacgccucccucgggaccuaccacgaccuuaaaaagaucgugagcaaggacuuccuggacaacuccgagaacgaggacauccucgagaacgucgugcugacccugacccucuuugaggaccgcgagaugauccggaagcgccuugaaaaguacaaggacauccugacggaagaacagcggaagaagcucgagcgccggcacuacaccggcugggggcgccugagcgccaagcugaucaacggcauccgggacaaggugacccgcaagaccauccucgacuaccuaaucgacgacggcacguccaacugcaacuucaugcagcugaucaacgacgacacccucagcuucgucgacgagauccggcuggcccagggcuccggcgaggccgaggacuaccgcgcggaggugcagaaccuggccgggagccccgccaucaagaagggcauucuccagucccugaagaucguggacgaacugaucgaggucaugggguacgaccccgaacacaucgugguggagauggcccgggagaaccaguucaccaaccagggccgcagaaacagccagcaacgguacaagaagaucgagaacgcgaucaagaaccucgacuccaaccugaacagcaagauccugaaggaauaccccaccaacaaccaggcccuccagaacgaccgccuguuccuguacuaccuccagaacggcaaggacauguacacggacgaggagcuggacaucgaccagcugagccaguacgacaucgaucacaucaucccgcaggccuucaucaaggacgacucccucgacaacaagguccugaccaagagcgccaagaaccgggggaaguccgacgacgugcccagccuggagaucguguacaagaaaaaguccuucuggaagcagcuccuggacagccagcucaucucccagcgcaaguucgacaaccucaccaaggccgagcggggcgggcugaccaacgaggacaaggcgcgguucauccagcggcagcuggucgagacccgccagaucacgaagcacguggcccggaugcucgacacccgcuucaauaccaagcuggacgaggccggcaaccggauccgcgaccccaaggugaacaucaucacccugaaguccaaccucgucucccaguuccggaaggacuaccagcuguacaaggugcgcgagaucaauaacuaccaccacgcccacgacgccuaccugaacgcggugguagccacggcccuccugaagaaguacccccagcuggccccggaguucguguacggcgaguacccaaccuacaacagcuacaacucccguaagagcgccaccgagaaggugcuguucuacuccaacaucaugaacuucuucaagcggaucgucgugcacagcaagaccggggaggugcggauccgccccgucaucgaggugaacaaggagacgggcgagaucgugugggacaagaaguccgacuuccggaccguccgcaaggugcugagcuacccccaggugaacgucgugaagaagaccgaggugcagaaccacgggcuggaccggggcaagccgaagggguucuacaacgcgaaccucagcccccgccccaaggagggcagcgucgagaaccuggugcccgccaagcagagcuucgacaccaagcgcuacggcggguaugccggcaucuccaacagcuacgccgugcuggucaacgggaucaucgagaagggcaagaagaaguccaaggcggaggugacggaguuccaggggaucagcauccucgcccggaaggacuucgacaagaacccgaagcaguaccugcugaaccucggcuacaaggacaucaaguccaucaucaagcugcccaaguacagccuguucgagcucgagaacggcucccgccggaugcuggccagcauccuguccaccaacaacaagcgcggggaaauccacaagggcaaugagauguaccuccccgacaaguucgugacccugcuguaccacgccaugcgggucaaccgcacucucgagccggggcacaagaaguacguggagacgcaccggcacguguucgacgagcugcugaucuacauccucgaguacaacgagaagaucgucggggccaaggcgaacgggaagcgcaucgucgaggccuacagcgccagaaaggacaccgacaaucuggaggagcuguguaacuccuucaucaaccuccugaaccugaccgcccucggcuccgccguggacuucgaguuccugggcacuaagaucccccgcuaccgggacuacacgcccuccagccugcucaaggcgacccugauccaccaauccgucaccgggcuguacgagacccgcauugaccucagcaagcugggcggggacuga

SEQ ID NO: 7858 - RNA, 4149 nt, Artificial Sequence
  Cas9 variant
augaagaagauagugaacuacaaccugggccuugacaucgggacgagcuccaucggcuacgccgccaucgacgaccaggggcgccccguccggcaccagaacaagacagugaugggcgugcgccuguucaaggaggggaagacggcggagagcacacgcaucuuccgcggcacccgucgccggcugucacaccgccacuggcggcucggcuaccuggaccgcaucuucgacaacgaaauagccaaggucgacgagaacuuccugccgcgguugaaggccucuaagcgcgcucgguccgacgagaagcgcagcuuccgcgggucccugcuguuccccgagaccggcgacgacgccuacuaccagaaguaccccacaaucuaccaccuccgcuacgcucugaucacccagaagaagcaguucgacauccggcugaucuaccucgcccugcaccacaugaucaaguaccgcgggaacuuccuagacacgacccccgugagcgccuuuaacauccacgacaucgaccucacggaccaauucgccucccugaacgacugcuaccagcugcucgacauggacuucgaguuccaguucgaccugaacaacaucgagcagguccagaagcugcuccuggacgagacccugagcaagaccaagaggcaggcggccguguccaaggugcucgugaugucaaccggcaacaaggccuucgacgaccagcagaacgggaucgccuccgaguucaucaaggcccugcugggcggcccguucgaccucagcaagauccugaaccugagcgucgcggacgucaagucguggaaacuccacaugacggacaaggacguggacgacacccugaacucccugguagaggagcuugacgagaaucacaagcagaucgugaaccuacugcagaugaucuacagucaggugaugaugcucgggcugcugaacggccagcaguccaucagcgccagcaugaucgagcgcuacgacgaccacgccaagcacugggccgcccucaagaagcugcugcccgcgcucggggaacaggagcaguccaccaucauccacgccuacaccgccuauacgggccacagcagaaccaagcagcugucccgcgccgaguucuacaccaaggucaacagcauccuuaagaagcacgagaacaucgccgaggcgacaggccucaucgagcugaucgaccgcaacgaguucaugcccaaacagcgggacgccguaaacggggugaucccccaccagcugcaccagcgcgagcuccagcugaucauccagaaccagcagaaguacuauccguuccuggccgcgaaagccuaccccgacgcggacgagacgaugaucgagcagcugcucuccuuucggguccccuacuacgccggaccccugguggaccgcgacuucauaaaugagagcuccgaccaggagcaggccaugcagaacaccaaguucagcuggcugaagcggcgcgaggccggugagaucaccccguggaacuucgagcagaagguggacguccaggagaccgcgaaccgguucaucaagcgccucacgaccaaggacaccuaccuuaugaccgaggacgugcugcccaaggagucccucaucuaccagcgguucgagguucugaaugagcugaacgccauccgcaucaacgaccggcgccucacggccgagaacaagcagcuggccuuccagcagcuauucauggccggcaacaccaaaaacgucagcaucaagaaguuccggaacuucguguucgacucccucaaauuccccgaaaaggucaagaucaccggguucgcgggccagcacaacuuccuggccaagcugagcaccuaccacgacuucaagaagaucuucggcgagcgcguggaccacacggaccuccagcccgacuucgagcggauuguggaguggugcaccaucuucgaggaccgccacaucuaccgggagaagcugaaggagauccaguggcugucccagagcgagaucgaccagcucguccugauccgcaaccacggguggggccggcuguccaagcgccuccugaccgggauccgcgacagcgacggccggacggugauggaccagcugugguucgggacggauaacuucaugcgcaucaucucacagagcgacuucgccgccgccaucgcgaacgagaaccggacccagcucaaccagcacggccuggaggacgugcuggacuccgccuucaugagcccgcagaacaagaaggccauccgccagguccucaaggugguggacgacauugagcagacccugggcugcccgcccaagaaggucaugaucgaguucacgcggagccccgacaagaagaagcagcgcaccgugacgcggcuggagaaggugcagcaggccuacaaggccgucgcggaccagcucgccgggcaguccaucgugagcgagcuggaucaguacgccaacacccacuccaagcugagcgacaccuacuaccucuacuucaugcagcugggccgcgaccuguacuccgggaagcccaucgacaucgacagcccgaugcucgacgacgaccacauacugccccgggccuucaugaaagauaacucccuggacaaccgcgcgcucacggagaagcccaucaacaacacgaaggccgccaaguucccgagcaagguguuuggccagcagaaggaggucaccgacuucuggaagcugcugcggcgcugcgggcucauguccaacaucaaggagaagcaccuguaccuggaccccgacaacguggacaaguggacccggcgcggcuucauccaccggcagcucguggagaccagccaggucaucaagaucguggccaacauccugaacgaccgauaccagcagucccagacggaggugcuggagguccccgcccggcucggcaccgagcugcgcgagugcuucgggugguacaaggugcgggagguaaacgacuaccaccacgucuucgacgcguaccuggccgccuucaucggcaacuaccucuaccgccgguaccccaagcugcagccguacuucguguacgggaacuucgccgagcugaacaaggcccagcucaagaacaucaagagcuucaacuuccuauacaacaucaccgauaacaagcgcguggucaaggacaucgagaccggccagacacugugggacgaccagauccgccagcagauccagcacaucuacgaguacaaguacaugcucaccucccacgaggcguucacccagcacaaggagcuguacggccagaccaucuacccccggcgcgaguucaagcccgggacccugaaggccaucaagcaggaccagccgcaggagcucuacggcggguacaagaaccugaccgccgccuacaugugcaucgugaagauccaggcccgaaagcgccgggcggccgaguaccgcgugguccggguggccaccgagucccuguccgcccuccagcaggcgaagcgccugggggugcaagccuacgagcggugccugcgccaggagcugguccggaacaacgagauccugcgcaccaacgccgaccccaacagcgcgccccgggaguucgagguucugcucgaccgcguacugugccaccagaugaucaucuccgacgggcagaaguaccugcucggcagccacgccuacaagaucaacugcaugcagcugguccugagcaacaacuccaugaagauccucagcacgaguauugugaagcugaagcagaugaccaacgagccccuggugcaggucuaccgggagauccucgacguggugaacaaguacuucacccuguacgacgucaacagcuuccgcgagaaccugaaccaguucuucgacaaguuccggacccucccgaucacgaacgaguacgagucaagcaaguccggcaagaagcugauccaccgcgggcagcuggagacccucacccugauccugcggggccuccacgccaacagcgacaaggugcaguacggggaucaguccacccugcugggcggguuccagacgaaggacggcaucaagcucagcaaggacuccgugauccaguacaccagcccggccggccugaacguccgcaccgugaagcugcgcgaccucgagcagaaggaggcccaaaaguga

SEQ ID NO: 7859 - RNA, 4149 nt, Artificial Sequence; identical to SEQ ID NO: 2059
  Cas9 variant

SEQ ID NO: 7860 - RNA, 4155 nt, Artificial Sequence
  Cas9 variant
augaacaagcccuacagcaucggccuggacaucgggaccaacucagucggcuggagcaucaucaccgacgacuacaaggucccggccaagaagaugaggguguuaggaaacacggacaaggaguacauaaagaagaaccugaucggcgcccuccucuucgacgggggcaacaccgcggccgaccggcgccuaaagcggaccgcccgccggcgcuacacccggcgccggaaccgcauccuguaccuccaggagaucuucgccgaggagaugucaaaaguggacgacagcuucuuccaccggcuggaggacagcuuccugguggaggaggacaagcgcggcagcaaguacccgaucuucgccacgcuccaggaggagaaggacuaccacgagaaguucucgaccaucuaccaccuccggaaggagcuggcggacaagaaagagaaagccgaccugcgccugaucuacaucgcccuugcccacaucaucaaguuccgggggcacuuccucaucgaggacgacagcuucgacgugcgcaacaccgacaucuccaagcaguaucaggacuuccuggagaucuucaacaccaccuuugaaaauaacgaccugcucucccagaacguggacgucgaggccauccugaccgacaagaucuccaagagcgcaaagaaggaccgaauccuggcccaauaccccaaccagaaguccaccgguaucuuugccgaguuccucaagcugaucguggggaaccaggccgacuucaagaaauacuucaaccuagaggacaagacgccucuccaguuugcgaaggacagcuacgacgaagaccuggagaaccugcucggccaaauaggggacgaguucgccgaccuguucuccgccgcaaagaagcuguacgacagcgugcuccuauccggcauccugaccgugaucgaccucagcacuaaggccccguuauccgcgagcaugauccagcgcuacgacgagcaccgggaggaccugaagcagcucaagcaguucgugaaggccagcuugcccgagaaguaccaggagaucuucgccgacuccagcaaggacggcuacgccggguacaucgagggcaagaccaaccaggaggccuucuacaaguaucuguccaagcucuugaccaagcaggaggacucggagaacuuccuggagaaaaucaagaacgaggacuuccuccgcaagcagcggacguucgacaacgggucgaucccccaucaggugcaccugaccgagcugaaggcgauaauccgccgccagagcgaguacuacccauuucucaaggagaaccaggaccggaucgagaagauccugaccuuccgcaucccguacuacaucgguccccuggcccgggagaaguccgacuucgccuggaugacccgcaaaacggacgacagcauacggcccuggaauuucgaggaccucgucgacaaggaaaaauccgccgaggccuucauccaccgcaugaccaacaacgacuuuuaccugcccgaggaaaaggugcugccgaagcacagccugaucuaugagaaguucacaguguacaacgagcucaccaagguccgguacaagaacgagcagggcgagacguacuucuucgacuccaauaucaagcaggagaucuucgacgggguguucaaggagcaccgcaaggugucaaagaagaagcugcuggauuuucucgcgaaggaauacgaggaguuccggaucgucgacgugauuggccuggacaaggagaacaaagccuucaacgccucccuggggaccuaccacgaccucgagaagauccuggacaaggacuuccuggacaacccagacaacgagagcauccucgaggacaucgugcagacccugacccuguucgaggaccgcgagaugaucaagaaacggcucgagaacuacaaggaucuguucacggagucccagcugaagaagcucuaccggcggcacuacaccggguggggacgccugagcgccaaacugaucaacggcauccgggacaaggagucccagaagaccauccucgacuaccugaucgaugauggccgcagcaaccggaacuucaugcagcugaucaacgacgaugggcgcuccaaucgcaacuucaugcagcucaucaacgacgacggccugagcuuuaaaagcaucaucuccaaggcgcaggcugggucacacuccgauaauuuaaaggaggucgugggcgagcuugccgggucgcccgccaucaagaagggcauccugcagucucugaagaucguggacgaacucgugaaggugaugggauacgagcccgagcagaucgucguggagauggcuagggaaaaccagaccacgaaccaggggcgccggaacagccgccagcgguacaagcugcucgacgacggugugaagaaccucgcgucggaccugaacgggaacauccugaaggaguacccgacugacaaccaggcccuccagaacgagcgccuguuccuguacuaccuccagaacggccgggacauguacaccggagaggcccuggacaucgacaaccugagccaguacgacauugaccacaucaucccccaggccuucaucaaggacgacuccaucgacaaccgcguccucgugucauccgccaagaaccggggaaagagcgacgacgugcccucccuggagaucgucaaggacugcaaggucuuuuggaagaagcuacuagacgcgaagcugaugagccagaggaaguacgacaaccugaccaaggccgagcggggagggcucacguccgacgacaaggcccgcuucauccagcggcagcugguggagacccgccagaucaccaagcacgucgcccggauccuggacgagcgcuuuaacaaugagcucgacuccaagggccggcgcauccggaaggugaagaucgugacccugaaguccaaccuggucagcaacuuccgcaaggaguucggguuuuacaaaauccgggagguuaauaacuaccaccacgcccaugacgcauaccucaacgccguggucgcaaaggccauccugaccaaguacccccagcuggagccggaguucguguacggcgacuaccccaaguacaacagcuacaagacgcgcaaguccgcgaccgaaaaguuguucuucuacagcaacaucaugaacuucuucaaaaccaaggugacucuggccgacggcacggucguggugaaggacgacaucgaggugaacaacgacaccggggagaucgugugggacaagaagaagcacuucgccaccgugcggaagguccuguccuacccccagaacaacaucgugaagaagaccgagauccagacgggcggguucagcaaggaguccauacucgcgcacggcaacagcgacaagcugaucccccgcaagaccaaggacaucuaccuggacccgaagaaguauggaggcuucgacucccccaucguggcuuacagcguccucgugguggcagauauuaaaaagggcaaggcccagaagcugaagaccgucaccgagcugcucggcauaacgaucauggagcgcucccgguucgagaagaaccccagcgcauuccuggaguccaagggcuaccugaacauccgagccgacaagcucaucauucucccuaaguacagccuguucgaacucgagaacgggcggcgccggcugcuagccuccgcgggugagcuccagaaggggaacgagcuggcccugccgacccaguucaugaaguuccuguaccuggccagccgcuacaacgaguccaaggggaagcccgaggagaucgagaagaaacaggaguucgugaaccagcacgugagcuacuucgacgacauccugcagcucaucaacgacuucuccaagcgggucauccuggccgacgccaaccuggagaaaaucaauaagcucuaccaggacaacaaggaaaacauaagcguggacgagcuggcgaacaauaucaucaaccuguucaccuuuaccucccucggagcccccgccgccuucaaauucuucgacaaaaucguggaccggaagcgauacacgucgaccaaggagguacugaacagcacccugauacaccaguccauaaccgggcucuacgagaccagaaucgacuugggcaagcugggggaggacuga

SEQ ID NO: 7861 - RNA, 4155 nt, Artificial Sequence
  Cas9 variant
augaaacuucgaggaauagaagacgacuacucaaucggacuagacauggggaccuccagcgucgggugggccgucacggacgagcgcggcacccuagcacauuucaagcgaaaaccaacaugggguagccgccuguuccgagaggcacagacagcagcgguagcgagaaugcccagagggcagcgccgccgcuauguacggagacgauggcgccuggaccugcuccaaaaauuauucgaacaacagauggagcaagccgacccagacuucuucaucagacuacgacagucgcgccuccugcgagacgaccgagccgaggaacacgcggacuaccgauggccccuguucaacgacugcaaauucaccgagcgagauuacuaccagagauucccaaccaucuaccacguaagguccuggcugauggaaacagacgagcaagccgacauaagacuaaucuaccucgcccuccacaauauagucaaacaccgaggcaacuuccuccgcgaggggcaaucccuaucggccaaauccgcgcgcccagaugaagcccuuaaucaucugcgcgagacacuccggguauggagcagcgagaggggauucgaaugcuccaucgcagacaacgguuccauccuagccaugcugacccacccugaucuauccccaagcgacagacgcaagaaaauagcgccccuguucgacgugaaauccgacgacgccgccgcagacaagaagcucggaaucgcacuagccggcgcaguuauaggccugaaaaccgaguucaaaaacaucuucggcgacuuccccugcgaagauucaucuaucuaccucucaaacgacgaagccgucgacgcaguaagaagcgccuguccagacgacugugcggaguuguucgaccgucuaugugaaguauacucggccuauguacuacaagggcugcugaguuacgcacccggccaaacaauaagugcaaacaugguagaaaaauaccgccgguacggagaagaccuggcguugcugaagaaauuagucaaaaucuacgcgccagaucaauaccgcauguucuuuaguggcgcgacauauccaggcaccggaauuuacgacgcagcucaggcacgaggguacacaaaauacaaccugggacccaaaaaguccgaauacaaaccaagcgaguccaugcaguaugacgacuuccgcaaagcagucgaaaagcuauucgccaagacagacgcccgcgccgacgagcgauaccgaaugaugauggaccguuucgacaaacaacaauuccugcgccgcuuaaaaaccucugacaacgggaguauauaccaccaacuacacuuagaggaacuaaaagccaucguugaaaaccaaggccgauucuacccuuuucuaaagcgagaugccgacaaacucgugucacucgucucauuccgcauucccuauuacgucggcccacucaguacucggaacgcucgcacggaccaacacggggaaaaccgauucgccugguccgaaaggaaaccggggaugcaggacgaacccauauucccauggaacugggaauccaucaucgaccgcucgaaaagcgccgagaaauucaucuugcgaaugacgggaaugugcacauacuuacaacaagagccgguccuccccaaaucaucccuacucuacgaggaguucugcguccuuaacgaacugaacggggcacauuggucgauugauggagaugacgaacacagauucgacgccgccgacagagaaggcaucaucgaagaacuuuucaggaggaaacgcaccgucagcuacggugauguggcagguuggauggaacgagaaagaaaccagaucggugcacacgugugcggcggccagggggaaaagggauucgaauccaaacugggaagcuacaucuucuucugcaaggacgucuucaaaguugagcgacuagaacaaucggacuacccgaugaucgagcggauaauccucuggaacacccucuucgaagaccgcaaaauccucagucaacgccugaaagaagaguacggcagccgacucucggccgaacagaucaagaccaucugcaagaagcguuucacgggguggggcaggcuaucagaaaaauuccucaccggcauaaccguacaagucgacgaggacucaguaucgaucauggacguccuucgcgagggaugcccagucuccggcaaacgcggccgugcgauggucaugauggagauccugcgagacgaagaacucggauuccagaagaagguagacgacuucaacagagcauucuucgcagaaaacgcucaagcccucggcgucaacgaacugccagguucaccggccguuagacgcucccucaaccagucaauccgcaucgucgacgaaauagcaagcauagccggcaaagcacccgccaauauauucaucgaagucacgagagacgaggaccccaaaaagaaagguaggcgaaccaaaagacgauacaacgaccuuaaagacgcacucgaagccuucaaaaaggaagaccccgaacucuggagagaacucugcgagaccgcgcccaacgacauggacgagcggcugucauuauauuucaugcaaagaggcaagugucuauacucaggacgggcuaucgacauacaccaacucucgaacgccgggauauacgaggucgaccacaucaucccccgaaccuacgugaaagacgacucacuggaaaacaaagcccucguauaccgagaagagaaccaacgaaaaacagacaugcugcucauagacccugaaaucagacgccgcaugucggguuacuggcggaugcuccacgaggcaaagcucaucggagacaagaaauuccgcaaccugcuccgcagcaggaucgacgacaaagcacuaaaaggguucaucgcacggcaacugguggaaaccggacaaauggucaagcuagugcgcucucuccucgaagcaagauauccagaaaccaauaucauaagugugaaagcaucuauuucacacgaucuacgcaccgcagcagaacuugucaaaugccgcgaagccaacgacuuccaccacgcccaugacgcauuccucgcuugccgcguaggcuuauucauccagaaaagacacccuugcgucuacgagaaccccaucggccuaucacaaguaguccgcaacuacguucgccaacaggcagacaucuucaaacgcugccgaacaaucccuggcagcucaggcuucaucguaaacagcuucaugacaucaggauucgacaaagaaaccggcgaaauauuuaaagacgacugggaugcggaagcagaagucgaaggcauaaggcgaagccuuaauuuccgacaaugcuucauaucccggaugcccuucgaagaccacggcguuuucugggacgccaccaucuacucgccaagagcaaagaaaaccgccgcgcugccauuaaaacaagggcuuaaccccucuagauacggcuccuucagccgggagcaauucgcuuacuucuucauauacaaagcccgaaacccgcgcaaagaacaaacauuauuugaauuugcccaaguacccguacguuuaagcgcccagauccggcaagaugaaaacgcacucgaaagauaugcacgggaacuugcaaaggaccagggacuugaguucauaaggaucgaacgaucuaagauacucaaaaaccaacugauagaaauagauggcgaccgacuauguauaacaggcaaagaagagguacggaacgcgugcgagcuagccuucgcccaagacgaaaugcgcgucauccgaauguuagugagcgaaaaacccgugagccgagaaugcgucaucucguuguucaaccggauuuugcuacacggcgaccaagcaagccggcgacuauccaaacaacuaaaacucgcgcuucucagcgaagccuucuccgaggcaucugacaacguacaacggaacgucguucucggccucaucgcaauauucaacggaagcaccaacauggucaaccucucagacauaggaggcagcaaguucgcuggcaacguuagaauaaaauacaagaaagaacuagcaucucccaaaguaaauguacaccugaucgaccaaucagucacagguauguucgaaagaagaacaaaaaucggccuauga

SEQ ID NO: 7862 - RNA, 4158 nt, Artificial Sequence; identical to SEQ ID NO: 2062
  Cas9 variant

SEQ ID NO: 7863 - RNA, 4158 nt, Artificial Sequence; identical to SEQ ID NO: 2063
  Cas9 variant

SEQ ID NO: 7864 - RNA, 4158 nt, Artificial Sequence
  Cas9 variant
auggacgagcugcagaacuucgagaagggcaagagcaucaccaccaacgccgaccgcacggccgggcgcuccaugcgccggaaucuccagcgcuacaagcugagacgcgagaaccugaucgaggugcucaaggaguacaacuucaucaccgacgagaugauccugagcgagaacggcaaccggaccaccuucgagacguaccgccugcgggcgaaggccgccguagaggagaucucccucgagcaguucgcccgcguguuacugaugaucaacaagaagcggggguacaagagcagucgcaaggccaagggcgcggagaacgggacccucaucgacggcauggagguggccaagaagauguacgacgagggcaucacccccggggagcugugccugcaguuacugaccgccgggaagcgguacuucccggacuucuaccgcagcgaccugcaggccgaguuugaccggaucuggaacuuccagaagcaguucuaccccgacucccucaucgacaaggucaaggacgaggugcgcgggaagaacaagagccagacgugggcgauccuggccaaguacuucguguggaaggagguggaaaauuccuggaacgaggaggaggcccagacccggcgcguggagaaggaguaccggcuggugggcaucaagcgcggggucaagagagaggagcucaagcuggagaauuuccaguggcgcgugaaggcccugagcgagcgcaugaaccccgaggagcucgccaucgugcugcaggagaucaacgagcagaucuccaacagcucaggcuaucugggcgcgaucagcgaccgguccaaggagcucuacuucaaccgucagaccgucgggcaguaccagauggccgugcuggacaacaaccccaacaucggccuacggaacaugguauucuaccgccaggguuaccucggagaguucaacaccaucugggagaagcaggccgaguuccacaaggagcugacggaggaccugaagaaagagauccgggauaucgucaucuucuaccagcgccggcucaagagccaaaagggccugauaaacaucugcgaguucgagcgccggcagaucgagguggagaucgacgggaagaagaagaucaaaaccaucggcucccgcgugaucccgcggagcagcccccuguuccaggaguucaagaucuggcagacccugaaugacaucgaggucagcgugcugggggugaagaacaagcgcaagaagcaggacgacaacagcaccacgcugcucgacuccgccgaaaacauugauagccugaagcugaacgucucgcggccccucgacgccgacgagaagucccugcuggcgaaggagcuguucauccgcgacaagcucaccaaguccgacgugcugaagcuccuguucaacaacccccagaaccugaaccucaauuucaagaauaucgacggcaaccguaccggcagcgcccuguaccaggccuucuccaagauccuggagaucagcggccacgaguccaucaacuucaagaaguccgccgaugagaucguggagcaggucaagaccauauucagcgcccuggguuggaacacggaggugcucugcuucgacagcgagaaggagcuggacaagcagccguacuuuaagcuguggcaccuccuguacuccuucgagggggacagcacccccaccggcgacgggaaccugauccagaagaucgcggacuugugcggcuucgagaaggacuacgccuccauccuggccaacaucaccuuccaggaggacuacgggagccuguccacgaaggccauccgcaagauucucccccaccucaaggacggcaaccaguacgacgucgccugcgaguacgcgggcuacaagcacagcaaguccagcuugaagaaggaggagaucaagaacaaggugcucaaggacaagcuggagcugcuccccaagaacagccugaggaacccgguggucgagaagauccugaaccagauggugaacgugaucaacgccaucaucaccaccuacgggaagcccgacgagauccgcaucgagcucgcccgggagcugaagaagaaggccaagaagcgcgaggagcugaccaagacgaucgucgacacaaccaagacccacgaggguauccgcgcgauacuccagaacgacuucggaaugucccacgugagccggaacgccaucauccgcuacaagcuguacgaggagcugaaggauaacggcuacaagacgcucuacuccaacaccuacauccccaaggagaagcuguucagcaaggacuucgacaucgaacacaucaucccgcaggcccggcuguucgacgacucuuucagcaacaagacacucgaggugaaauccaucaacaucgagaaggggagcaaaaccgccuacgacuucgucgaggagaaguacggcgagcagggccugcaggaguaccugaaccgcugcgaaguccucuuccgggacaagaagacgaagcugcgcaagcugaagaugcaggaguccgagaucccggagggguucaucgaccgggaccuccgcaacacccaguacaucgccaagaaggcgcugagcaugcugaacgagaucugccggcgcgugguagccaccaccggcgccaucaccgacgagcuccgggaggacuggcagcugguggacgugaugaaggagcugaacugggagaaguacaagguccucgggcugguggaguacuucgaggacaacgacggccgccugaucggccggaucaaggacuggacaaagcgcaacgaccaccggcaccacgccauggacgcccucaccguggcguuuaccaaagacgucuucauccaguacuucaacaauaagaacgccucccugaagcccgacaccaacgaggccgccauccgcaacaaguacuuccagaacgggaaggccaucccgcccaugagccuggacgaguuccgggcggaggccaagaagcacuugaacgacacgcugaucuccaucaagaccaagaacaagguggugaccaucaaucugaaccgcaccaagaagaagaacggcaucaauaagaagcagcagcagacgcccagagggcagcuccaccuggagaccgucuacggcagccacaagcaguacguggugaaggaggaaaaggucaacgccaguuucgacgccgcgaagaucgccaccgugaacaagcccgccuaccgcgacgcccugcuccggcgccugcaggagaacgggaacgacagcaagaaggccuuuaccggcaaaaacucccuggacaagcagcccguguggcucgacgcgaagcagaacgagugcguccccgagaaggugaagacgguaaugcuggagaccgucuacaccgugcgcaagccgaucgacgagaagcugaacguggacaagguaguggacgcccggauccgcaagcuccugcaggaccggaucaaggaguacggcaacgccaagagcgccuucgccaaccuggacgagaaccccaucuggcucaacaaggagaaggggaucaccaucaagcgcgugucggucuccggcaucaguaaggcgcagucccugcacgagaagaaggacaaggacgggaacuucauccuggacaaggacagccggcgcauccccguggacuucgugaacacgggcaacaaccaccacgucgccaucuaccggaagcccgugcucgacaagaaggggcaggccguguucgacgaaaacggcgagcugaaguucgagcuggaggaggucgugguguccuucuuugacgccgucacccgcgugaaucuuagccagccgaucaucgauaaggacuacaagcgguccgagggcuggaaguuccuguucagcaugaagcagaacgaguacuucguguucccgaacgagaagaccggguucgaccccaaggagaucgaccugcucaacccggagaacuacgcccugaucucccccaaccuguuccgcguccagaagaucgcgagcaaggacuacguguuccggcaccacuuggagaccguggucgccgaccguaaggaguuacaggagauaacguggaagcggaucuccagccuguccauccucaaccgcaucaucaaggugcgggucaaucacaucggccagaucgugaugaucggcgaguauuga

SEQ ID NO: 7865 - RNA, 4158 nt, Artificial Sequence
  Cas9 variant
augaccaagcccuacagcaucggccuggacaucgggaccaacuccgugggcugggcugucaucacggacgacuacaaggugccaagcaagaagaugaaagugcucgggaacaccuccaaaaaguacaucaagaagaaccugcugggcgcccuccuguucgacagcgggaucaccgcggagggccgccggcugaagcgcaccgcccggcgccgguacacgcgccggcgcaacaggauccucuaccuacaggaaaucuucuccaccgagauggccacccuggacgacgccuucuuccagcgccucgacgacagcuuccugguccccgacgacaagcgggacuccaaguaccccaucuuuggcaaccugguggaggagaaggcuuaccacgacgaguuccccacgaucuaccaccuccgcaaguaccuggcggacagcacgaagaaggccgaccugcggcucguguaccuggcccuggcccacaugaucaaguaccgcgggcacuuccuuaucgagggcgaguuuaacuccaagaacaacgacauccagaagaauuuccaggacuuccuggacaccuauaacgcgaucuucgagagcgaccugucccucgagaacagcaagcagcuggaggagaucgucaaagacaagauuuccaagagcgccaaaaaggaccggauccugaagcuguucccgggggagaagaacuccggcauuuuuagcgaguuccugaagcugauuguggggaaccaggccgacuucaagaaguacuucaaucucgacgagaaggcgccccugcacuucucaaaggagagcuacgacgaggaccuggagacccuccugggcuacaucggcgacgacuacuccgacguuuuccugaaggccaagaagcucuacgacgccauccugcugagcgggauccucaccgucacggacaacggcaccgaggcgccccuaagcuccgcgaugaucaugcgcuacaaggagcacgaggaggaccuggcccuccugaaggccuacauccggaacaucagccuggagaccuacaacgagguguucaaggacgacaccaagaacgguuacgccggcuacaucgacggcaagacgucccaggaggacuucuacgugcaccucaagaaacuucuggucggacuugagggcgccgacuacuuccuggagaagaucgaccgcgaggacuuccugcggaagcagcgcaccuucgacaacgggagcauccccuaccagauccaccuccaggagaugcgggccauccuggacaagcaggccaaguucuacccguuccuggccaagaacaaggagcgcaucgagaagauccugaccuuccgcauccccuacuacgugggccccuuagcgcgcgggaacuccgacuucgccugguccauccgcaagcggaacgagaagaucacccccuggaacuucgaggacgugaucgacaaggaguccagcgccgaggcguucaucaaccgcaugacguccuucgaccuguaccugccggaggagaaggucuugcccaagcacagucugcuguacgagaccuucaacguguacaacgagcucaccaaggugcgguucauagccgaguccaugcgcgacuaccaguuccuggacagcaaacagaagaaggacaucguccggcuguacuucaagaacaagcgccgggugaccgauaaggacaucaucgaauaccuccacgcgaucgacggcuacgacggaaucgagcugaaggggaucgagaaacaguucaacuccagccuguccacguaccacgaccuccugaacaucaucaacgacaaggaguuccucgacgacagcuccaacgaggccaucaucgaggaaaucauccacacccucaccaucuucgaggaccgcgagaugaucaagcagcgguuaagcaaguucgagaacaucuucgacaagagcgugcucaagaagcucagccgccggcacuacaccggcugggggaagcugagcgccaagcugaucaacggcaucagggacgagaaguccgggaacacgauccucgacuaccugaucgacgacggcgucaguaaccggaacuucaugcagcugauccacgacgacgcacucuccuucaagaagaagaucaagaaggcgcagaucaucggcgacaaggacaacaucaagcaggucgugcaggcccugcccgggcgccccgccaucaagaagggcauccuucagagcaucaagaucguggacgagcucgugaaggucauggggcggcgcccggaguccaucgugguggagauggcccgggagaaccaguacaccaaccagggcaagagcaacucccagcagaggcugaagcgccuggaggagagccucaaggagcugggguccaagauccugaaggagaacauccccgccaagcucagcaagaucgacaacaacgcgcugcagaacgaccggcuguaccucuacuaccugcagaacggcaaggacauguacaccggcgaggagcuggacaucgaccgcuuauccaacuacgacaucgaccacaucaucccccaggccuuccugaaggacaacagcaucgacaauaagguccugguguccagcgccuccaaccgggggaaguccgacgacgugcccagccucgaggucgugaagaagcgcaagacccugugguaccagcugcucaagagcaagcugaucagccagcggaaguucgacaaccugacgaaggccgagcgcggcggccucuccccggaggccaaggcgggcuucauccagcggcagcugguggagacccgccagaucaccaagcacgucgcccggcugcucgacgagcgcuucaacaacaagaaggacgaagacaacaagacccugcggacggugaagaucaucacccucaagagcucccucgugagccaauuccgcaaggacuuugagcuguacaagguccgggagaucaaugacuuccaccacgcgcacgacgccuaccugaacgccgugguggcguccgcccuccugaagaaguaucccaagcuggagcccgaguucgucuacggcgacuaccccaaguacaacagcuuccgcgagcggaagucggccaccgagaagguauacuucuacagcaacaucaugaacaucuucaagaaguccauuagccucgccgacgggaccgugaucgagcgcccccugaucgaggucaacgaggagaccggcgagagcguguggaacaagguggcagaccugaacacgguccggaaggugcucucguacucccaggugaacaucgucaagaagguggaggagcagaaccacgggcuggaccgcggcaagcccaaagggcuguucaacgccaaccucagcuccaagcccaagcccaacagcaaggagaaccuggugggcgccaaggaguaccuggacccgaagaaguacggcggguacgccggcaucuccaacagcuucgccguccucgugaaggggaccaucgagaagggcgcgaagaagaagaucaccaacauccuggaguuccaggggaucuccauccuggaccggaucaccuaccgcaaggacaaguucaacuuucuccuggagaagggcuacaaggacaucgaccugaucaucgagcuccccaaguacagccucuucgagcugagcgacggcucccggcgcaugcucgccagcauccugucaacgaacaacaagcgcggggagauccacaagggcaaccagaucuucaucagccagaaguacgugaagcugcucuaccacgccaagcggaucuccaacaccuuuaacgacaaccaucgcaaguacgucgagaaccacaagaaggaguucgaggagcuguucuacuacauccuggaguucaacgagaacuacgugggggccaagaaaaacggcgagcuccucaagagcgccuuccaguccuggcagaaccacagcaucgacgagcugugcuccagcuucaucgggcccaccggcuccgagcggaagggccucuuugagcugaccagccgcgggggcgcggccgacuucgacuuccugggggugaagaucccgcgguaccgcgacuacacgcccuccagccuccugaaggacgcgacgcugauccaccagucagucaccggccucuaugagacccgaaucgaccuggggaagcugggcgaggacuga

SEQ ID NO: 7866 - RNA, 4158 nt, Artificial Sequence; identical to SEQ ID NO: 2066
  Cas9 variant

SEQ ID NO: 7867 - RNA, 4161 nt, Artificial Sequence
  Cas9 variant
augaaccagaaguacagcaucggccuggacaucgggaccaacuccgugggcugggccgucaucaccgacgacuacaaggugcccgccaagaagaugaaggugcucgggaacacugacaagcagagcaucaagaagaaccugcuuggcgcgcugcuguucgauuccggggagaccgccgaggccacccgacugaagcggaccgcccgccggcgcuacacgcggcgccggaaccgccuccgguaccuucaggagaucuucgccgaggagaugaugcaggucgacgagagcuucuuccagcgccuggacgacuccuuccucguggacgaggacaagcggggcgagcgccacccgaucuucggcaacaucgcggccgaggugaaguaccaugacgaguuccccaccaucuaccaccuccggaagcaccuggccgacaucagccaaaaggccgacuugagacuggucuacuuggcgcuggcccacaugaucaaguuccgggggcauuuccugaucgaaggccagcugaaggccgagaacaccaacgugcaagcccucuucaaagacuucguggaggucuacgauaagaccguggaggagucccaccugagcgagaucacgguggacgcccuguccauccucaccgagaaggucagcaagucccgccggcuggagaaccuaaucgcgcacuaccccgccgagaagaagaacacccucuucgggaaccucaucgcccuguuccucggccugcagcccaacuucaagaccaacuuccagcugagcgaggacgccaaguugcaguucuccaaggacacguacgaggaggaccuggaggggcugcucggcgaggugggcgacgaguacgccgaccuguucgcgagcgccaagaaccuguacgacgccauccuccuguccgggauccugaccguggacgacaacagcaccaaggccccucucuccgccagcauggucaagcgcuacgaggagcaccaaaaggaccugaagaaauucgaggacuucaucaaggugaacgcgcuggaccaguacaacgccaucuucaaggacaagaacaagaagggcuacgccggguacaucgagucuggugugaagcaggacgaguucuacaaguaccucaagggcauccugcugcagaucaacgggagcggcgacuuccucgacaagaucgaccgggaggacuuccugcgcaagcagcggaccuucgacaacgggagcauuccccaccagauccaccuccaggagaugcacgccauccugcgccgccagggggagcacuaccccuuccugaaggagaaccaggacaagaucgagaagauccugacguuucggauccccuacuacgucgggccucuggcccguaagggcucccgguucgcgugggccgaguacaaggccgacgagaaaaucacccccuggaacuucgacgacauacucgacaaggagaaguccgccgagaaguucaucacccgcaugacccugaacgaccuguaccuccccgaggagaagguucugcccaagcacagccugcucuacgagacguucaccguguacaacgaguuaaccaaggucaaguacgugaacgagcagggcgaggcgaaauucuucgacgccaacaugaagcaggagaucuucgaccacguguuuaaggagaaccggaaggucaccaaggacaagcugcuaaacuacuugaacaaggaguucgaggaguuccgcaucgugaaccugacggggcuagacaaggagaacaaggucuucaacagcucccugggcaccuaccacgaccugcggaagauccucaacaagagcuuccuggacaacaaggagaacgcccagaucaucgaggacaucauccagacgcugacccucuucgaggaccgcgagaugauccggcagcgccugcagaaguauuccgacaucuucacgaaggcccagcugaagaagcucgagcggcgccacuacaccggguggggccggcuaagcuacaagcugaucaacgggauccgcaacaaagagaacaagaagaccauccucgacuaccugaucgacgacggcuacgccaaccggaacuucaugcagcugaucaaugacgacgcgcucuccuucaaggaggagaucgccaaggcccagaucaucggcgacguggacgacaucgccaacguuguccacgaccugccugggagccccgcgaucaagaagggcauccugcaguccgugaaaaucguggacgagcuagucaaggugauggggcacaaccccgcuaacaucaucaucgaaauggcgcgcgagaaccagaccacggaccggggccgccggaacagccagcagcgccugaagcugcuccaggacucccucaagaaccuggacaaccccgugaacaucaagaacgucgagaaccagcagcuccagaaugaccgucuguuucuguacuacauccagaacgggaaggacauguacaccggcgaaacccucgacaucaacaaccugagccaguacgacaucgaccacaucaucccgcaggccuacaucaaggacgacuccuucgacaaccgggugcugaccagcuccagcgagaaccgcggcaaguccgacaacgugcccagcaucgaggucgugugcgcccggaaggccgacuggaugcgccuccggaaggcggggcugaucucacagcgcaaguucgacaaccugacgaaggccgagcggggagggcugaccgagaacgacaaggccggcuucaucaagcgccagcugguggagacccggcagaucaccaagcacgucgcccaggugcuggacgcgcgcuucaacgccaagcacgacgagaacaagaaggugauccgggacgucaagaucaucacccucaaguccaaccuggugagccaguuccgcaaggacuucaaguucuacaaggugcgggagaucaacgacuaccaccacgcccacgacgccuaccugaacgccgugauuggcacggcgcuccugaagaaguaccccaagcuggccucagaguucguguacggggaguucaagaaguacgacgugcgcaaguucaucgccaagagcgacaaggaaaucggcaaggccaccgccaaguacuucuucuacuccaaccucaugaacuucuucaagaaggagguaaaguucgcggacgggaccgugguggagcggcccgacaucgagaccagcgaggacggcgagaucgccuggaacaaacagacggacuucaagaucguccgcaaggugcuguccuacccccaggugaacaucgucaagaagaccgaggugcagacccacgggcuggaccggggcaagccgcgcggccucuucaacgccaaccccagccccaagccgaagcccgacuccagcgagaaccuggugggggucaagcggaaccuggaccccaagaaguacggcggguacgccggcaucuccaacagcuacgccgugcucgugaaggcgaucauagagaagggggucaagaagaaggagaccauggugcuggaguuccagggcaucuccauccuggaccgcaucacguucgagaaggacaagagagccuuccuccugggcaagggguacaaggacaucaagaagaucaucgagcugcccaaguacucucucuucgagcugaaggacggcucccgccgcaugcuggccagcauccucuccaccaacaacaagcgcggggagauccacaagggcaacgagcuguucgugccgcagaaguucaccacccugcucuaccacgccaagcggaucaacaaccccaucaacaaagaccacaucgaguacgucaagaagcaccgggacgacuucaaggagcugcugaacuacgugcucgaguucaacgagaaguacgugggagcgacgaagaauggcgagcgccugaaggaggccgucgccgacuucgacagcaagagcaacgaggagaucugcaccuccuuccugggggccgugaauagcaagaacgccgggcuguucgagcugaccucccugggcagcgcgucggacuuugaguuccuaggggugaagaucccccgguaccgcgacuacaccccgagcucgcugcugaaggacagcacgcucauucaccaguccauuaccggccuguacgagacccggaucgaccugagcaagcucggggaggacuga

SEQ ID NO: 7868 - RNA, 4161 nt, Artificial Sequence; identical to SEQ ID NO: 2068
  Cas9 variant

SEQ ID NO: 7869 - RNA, 4164 nt, Artificial Sequence; identical to SEQ ID NO: 2069
  Cas9 variant

SEQ ID NO: 7870 - RNA, 4167 nt, Artificial Sequence; identical to SEQ ID NO: 2070
  Cas9 variant

SEQ ID NO: 7871 - RNA, 4167 nt, Artificial Sequence
  Cas9 variant
augaccaagcccuacagcaucggccuggacaucgggaccaauuccgugggaugggccgucaucacggacaacuacaaggugccgagcaagaagaugaaggugcucgggaacaccucuaagaaguacaucaagaaaaacuuacugggcguccuccuguucgacagcgggaucaccgccgagggccgccggcugaagcgcaccgcgcggcgccgguacacgcgccggcgcaaccggauccucuaccugcaggagaucuucuccaccgagauggccacccuggacgacgccuuuuuccagcgccucgacgacagcuuucuggugcccgacgauaagcgggacuccaaguaccccaucuucggcaaccugguggaggagaaggucuaucacgacgaguuccccaccaucuaccaccuccgcaaguaccuggccgauagcacgaagaaggccgaccugcggcucguguaccuggcacuggcccacaugaucaaguaccgcgggcacuuccucaucgagggcgaguucaacuccaagaacaacgacauucaaaagaacuuccaggacuuccuggacaccuacaacgccaucuucgaaagcgaccugucccucgagaacagcaagcagcuggaggagauugugaaggacaagauuuccaagcuggagaagaaggaccggauacucaagcuguucccgggggagaagaacagcggcaucuucuccgaguuucugaagcucaucgucgggaaccaggccgacuuccggaagugcuucaaccuggacgagaaggcgagccugcacuucuccaaggagagcuacgacgaggaccucgagacccugcugggcuacaucggcgacgacuacuccgacguguuccucaaggccaaaaagcuauacgaugccauccugcucagcggguuccugaccgugaccgacaacgagaccgaggcgccccugagcuccgccaugaucaagcgguacaacgagcacaaggaggaccucgcccugcugaaagaguacauccgcaacaucagccucaagaccuacaacgaggucuucaaggacgacaccaagaacggcuacgccgguuacaucgacggcaagacgaaccaagaggacuuuuacguguaccugaagaaccugcucgccgaguucgagggagccgacuacuuccuggagaagaucgaccgggaggacuuccugcgcaagcagcggaccuucgacaacggguccauccccuaccagauccaccuccaggagaugcgcgccauccuggacaagcaggccaaguucuaccccuuccuggccaagaacaaggagcgcaucgagaagauccugaccuuccggaucccguacuacgugggcccccucgcccgcgggaacagcgacuucgccugguccauccggaagcgcaacgagaagaucacccccuggaacuucgaggacgucaucgacaaggagagcuccgccgaggcguucauuaaccggaugacgagcuucgaccuguaccugcccgaggagaaggugcucccgaaacacucccugcuguacgagaccuucaacguguacaacgagcucaccaagguccgcuucaucgccgagagcaugcgggacuaucaguuccuggacuccaagcagaagaaggacaucgugcgacuguacuuuaaggacaagcggaaggugaccgacaaggacaucaucgaguaccuccacgccaucuacggcuacgacgggaucgagcugaagggcaucgagaagcaguucaacagcucccugagcacguaccacgaccuccugaacaucaucaacgacaaggaguuccuggacgacuccagcaacgaggccaucaucgaggagauuauccacacccucaccaucuucgaggaccgcgagaugaucaagcagcggcuguccaaguucgagaacaucuucgacaagagcguacugaagaagcucucccgccggcacuacaccggcugggggaagcugagcgccaagcugaucaacggcauccgcgacgagaaguccgggaacacgauccucgacuaccugaucgacgacggcaucagcaaccggaacuucaugcagcuaauccacgacgaugcgcucagcuucaagaagaaaauccagaaggcccagaucaucggggacgaggacaagggcaacaucaaggagguagugaagucccugcccggcagccccgccaucaagaaggggauccugcaguccauaaagaucgucgacgagcucgugaaggucaugggcgggcgcaagcccgagagcaucgugguggagauggcccgggagaaucaguauaccaaccagggcaaguccaacagccagcagcgccugaaacggcuggagaagucccucaaggagcuggggagcaagauccugaaggagaacaucccggcgaagcucuccaagaucgacaauaacgcccugcagaacgaccgccuguaccucuacuaccugcagaacggcaaggacauguacaccggcgacgaccuggacaucgaccgccucagcaacuacgacaucgaccacaucaucccccaggccuuccugaaggacaacuccaucgacaacaagguccugguuagcuccgccagcaaccgggggaaguccgaugacuuccccagccuggagguggucaagaagcgcaagaccuucugguaccagcugcuaaagagcaagcugaucucccagcggaaguucgacaaccugacgaaagccgagcgcggcgggcugcuccccgaggacaaggcgggcuucauccagcggcagcugguggagacccgccagaucaccaagcacguggcccggcugcucgacgagaaguucaacaacaagaaggacgagaacaaccgcgccguccggaccguuaagaucaucacgcucaagagcacccuggugucccaguuucgcaaggacuucgagcuuuacaagguccgggaaaucaacgacuuccaccacgcccacgacgccuaccugaacgcggugaucgccagcgcccugcucaagaaguacccgaagcuggagcccgaguucguguacggcgacuaccccaaguacaacuccuuccgcgagcgcaagagcgccaccgagaaggucuacuucuacuccaacaucaugaacaucuucaaaaaguccaucagccuggccgacgggcgggugaucgagcggccccucaucgaggugaacgaggagaccggcgagagcgucuggaacaaggaguccgaccuggcgaccgugcgccgggugcugagcuacccgcaggucaacguggugaagaaggucgaagaacagaaccacgggcucgaucgcggcaagcccaaggggcuguucaacgccaaccuguccagcaagcccaagcccaacuccaacgagaaccucgugggcgccaaggaguaccuggacccgaagaaguacggcggguacgccggcaucagcaacuccuucgcgguucuggucaaggggacgaucgagaagggcgccaagaagaagaucaccaacgugcucgaguuccaggggaucagcauccuugaccggaucaacuaccgcaaggacaagcugaacuuccuccuggagaagggcuacaaggacaucgagcugaucaucgagcuccccaaguacuccuuauucgagcugagcgacggcucacggcgcaugcucgccuccauccugagcaccaacaacaagcgcggggagauccacaagggcaaccagaucuuccugucccagaaguucgugaagcuccuguaucacgccaagcggaucagcaacaccaucaacgagaaccaccgcaaauacgucgagaaccacaaaaaggaguucgaggagcuguucuacuacauccucgaguucaacgagaacuacgugggggccaagaagaacggcaagcugcugaacuccgcguuccagagcuggcagaaccacuccaucgacgagcucugcagcuccuuuaucgggcccacgggcagcgagcggaagggccuguucgagcugaccucccgcgggagcgccgccgacuucgaguuccucggcgugaagaucccgcgguaucgcgacuacacccccuccucucugcugaaggacgccacccucauccaucaguccgucacggggcuguacgagacucggaucgaccuggccaagcugggcgagggguga

SEQ ID NO: 7872 - RNA, 4167 nt, Artificial Sequence
  Cas9 variant
augacuaagcccuacagcaucggccuggacaucgggaccaacuccguaggcugggccgucaucacggacaacuacaaggugccgagcaagaagaugaaggugcucgggaacaccuccaagaaguacaucaagaagaaccugcugggcguccuccuguucgacagcgggauuaccgccgagggccgccggcugaagcgcaccgcgcggcgccguuacacgcgccggcgcaaccggauccucuaccugcaagagaucuucuccaccgagauggccacccuggacgacgccuucuuccagcgccucgaugacagcuuccuggugcccgacgacaagcgggacuccaaguaccccaucuucggcaaccugguggaggagaaggccuaucacgacgaguuccccaccaucuaccaccuccgcaaguaccuggccgacagcacgaagaaggcggaccugcggcucgucuaccuggcccuggcccacaugaucaaguaccgcgggcacuuccucaucgagggagaguucaacuccaagaacaacgacauccagaagaacuuccaggacuuccuggacaccuacaacgccaucuucgagagcgaccugucccucgagaacagcaagcagcuggaggagaucgugaaggacaagaucuccaagcuggagaaaaaggaccggauccucaaguuguucccgggggagaagaacagcggcaucuucucggaguucuuaaagcucaucguggggaaccaggcggacuuccgcaagugcuucaaccuggacgagaaagccagccugcauuucuccaaggaaagcuacgacgaggaccucgagacccugcugggcuacaucggcgacgacuacuccgacgucuucaucaaggccaagaagcucuacgacgccauacugcugagcggguuccucaccgugacugacaaugagaccgaggccccgcugagcuccgcgaugaucaagcgguacaacgagcacaaggaggaccuggcccuccugaaggaguacauccgcaacaucagccugaagaccuacaacgagguguucaaggacgacaccaagaacggcuacgccggcuacaucgacggcaagacaaaccaggaggacuucuacgucuaccucaagaaccugcuggccgaguucgaaggcgccgacuacuuccucgagaagaucgaccgggaggacuuccugcgcaagcagcggaccuuugacaacggguccauccccuaccagauccaccuccaggagaugcgcgcgauccucgacaagcaggccaaguucuaccccuuccuggccaagaacaaggagcgcaucgagaagauccugaccuuccggaucccguauuacgugggccccuuggcccgcgggaacagcgacuucgcuugguccauccggaaacgcaacgagaagaucacgcccuggaacuucgaggaugugaucgacaaggagagcuccgcggaggccuucaucaaccggaugacgagcuucgaucucuaccugcccgaggagaagguccugccgaagcacucucuccuguacgagaccuucaacguguacaacgaacugaccaaggugcgcuuuaucgccgagagcaugcgggacuaccaguuccucgacaguaagcagaagaaggacaucguccgccuguacuucaaggacaagcggaaggugaccgacaaggacaucaucgaguaccugcacgccaucuacggcuacgacgggaucgagcucaagggcaucgagaagcaguucaacagcucccugagcacguaccacgaccugcucaacaucaucaacgacaaggaguuccuggacgacagcagcaacgaggccaucaucgaggagaucauccacacccugaccaucuucgaggaccgcgagaugaucaagcagcgacucuccaaguucgagaacaucuucgacaagagcguacuuaagaagcugucccgccggcacuacaccggcugggggaagcucagcgcgaagcugauuaacggcauccgcgacgagaagucggggaacacgauccuggacuaccucaucgacgacggcaucagcaacagaaacuucaugcagcugauccacgacgacgcccugagcuucaagaagaagauccagaaggcccagaucaucggggacgaggacaagggcaacaucaaggaggucgugaagucccucccgggcagcccagccaucaagaaggggauccugcaguccaucaagaucguggacgagcuggucaaggugaugggcgggcgcaagcccgagagcaucgucguggagauggcgcgggagaaccaguacaccaaccagggcaaauccaauagccagcagcgccucaagcgguuagagaagucccugaaggagcucgggagcaagaucuuaaaggagaacauaccggccaagcuguccaagaucgacaacaacgcccuccagaacgaccgcuuauaccuguacuacuugcagaacggcaaggacauguacaccggcgacgaccuggacaucgaccgccugagcaacuacgacaucgaccacaucaucccccaggccuuccucaaggauaacuccaucgacaacaaggugcuggucagcuccgccagcaaucgggggaaguccgacgacuuccccagccuugagguggugaagaagcgcaagaccuucugguaccagcuccucaagagcaaacugaucucccagcggaaguucgacaaccugacgaaggcggagcgcggcgggcugcugcccgaggacaaggccggcuucauccagcggcagcucgucgagacccgccagaucaccaagcacguugcccggcugcuggacgaaaaguucaacaacaagaaggacgagaacaaccgcgccgugcggaccgucaagauaauuacgcucaagagcaccuuggugucccaguuccgcaaagacuucgagcuguacaaggugcgggagaucaacgacuuccaccacgcccacgacgcguaccucaacgccgucaucgccagcgcccugcugaagaaguacccgaaacucgagcccgaguuuguguacggcgacuaccccaaguacaacuccuuccgcgagcgcaagagugccaccgagaagguguacuucuacuccaacaucaugaacaucuucaagaaguccaucagccuggcggacgggcgggucaucgagcggccccugaucgaggugaacgaggagaccggcgagagcguguggaacaaggaguccgaccucgccaccguccgccgggugcugagcuacccccaggugaacgucgugaagaagguggaggagcagaaccacgggcuggaccgcggcaagccaaagggguuguucaacgcaaacuuauccagcaagccaaagcccaacuccaacgagaaccuggucggcgccaaggaguaccucgacccgaagaaauacggcggguacgcgggcaucagcaacuccuucgccgugcuggugaaagggacgaucgagaagggcgccaagaagaagaucaccaacguccuggaguuccaggggaucagcauccucgaccggaucaacuaccgcaaagacaagcugaacuuccugcucgagaagggcuacaaggacaucgagcugaucaucgagcugccaaaguacucccucuucgagcuguccgacggcagccggcgcaugcuggccuccauccucucuacgaacaacaagcgcggggagauccacaagggcaaccagaucuuccugucccagaaguucgugaagcugcucuaccacgccaagcggaucagcaacaccaucaacgagaaccaccgcaaguacguggagaaccacaagaaggaguucgaggagcuguucuacuacauccuggaguucaacgagaacuacgucggggcgaaaaagaacggcaagcuccugaacuccgccuuccagaguuggcagaaucacuccauagacgagcugugcagcuccuucaucgggccuacgggcagcgagaggaagggccucuucgagcugaccucccgcgggagcgcggcggacuucgaguuccugggugugaaaauccaacgguaccgcgacuacaccccguccagccuccugaaggacgccacccugauccaccagucugugacggggcucuacgagacccggaucgaccuggcgaagcugggcgagggguga

SEQ ID NO: 7873 - RNA, 4167 nt, Artificial Sequence; identical to SEQ ID NO: 2073
  Cas9 variant

SEQ ID NO: 7874 - RNA, 4170 nt, Artificial Sequence
  Cas9 variant
augaucauccgcaccuaugagcugaagaccauuacgacgaucgccauacucaagauguuccaguuacugaccggcgggcucagcaugaccaagcugggcaagccauauggcauuggcguggacaucggguccaauagcaucggcuucgccgcggucgacgagaacucccaucugauccggcucaagggcaagacggugaucggggcccgccuguucgaggaggguaaagccgccgccgaccggcgcgcgagccggaccacccgcaggcgccucucccggaaccgcuggcggcucagcuuccugagagacuucuuugagucgcacaucaccccgacggggcccaacuuuuucaugcggcaaaaguacagcgagaucucuccaaaggacaaggcccgcuauaaguacgagaagcggcuguucaacgaccgcaccgacgccgaguucuaccagcaguaccccaccauguaccaccucaggaaccgccugcugaccgacccgagcaaggccgacgugagagagaucuauuuugcgauacaccacauccucaagucccgcggccacuuccugacgagcgguuacgccaaggacuucaacaccaacaagguugcacuaaacgagaucuuccccgccuugcaggaugccuacgcccagguguacccggaccuggacaucaccuucgacgagaauaaggugaacgaguucaagaccguccugcucaacgaaaaggcgacccccuccgacacccagagggcccuggugaaccugcugcuggccgaggacggcgacaaagacauccuaaagcagcagaagcagguccucaccgaguucgccaaggcugugguuggacucaagaccaagcugaauguggcccucggaacggaggucgacagcuccgaggcuaccgucuggaacuucucucugggccagcuggacgacaagugggccgggaucgaguccgccaugaccgacgaaggcaccgagauacucgaccagauccgcgaccuguaccgcgcgcggcugcucaacggcaucgugccggccgggaagacgcugucucaggccaaggucgacgacuacgcccagcaccacgaggacuuagagcuguucaaggacuaccugaagcagcuggaggacgacggaaccgccaaggccaucaggcagcucuacgaccgguacauagacggggaugaugcgaagcccuucgugcgcgaggacuucgugaaggcccuuaccaaggaggucaccgcccaucccaacgcgaagucccccgagcugcucgaacggcuggcccagccggacuucaugcugaagcagcgcaacaaggccaacggcgccauccccguucagaugcagcaacgggagcucgaccagaucaucaagaaccagagcguguauuaugacuggcuggccgcgcccaaccccgucgagaagcacagaaagagcaugccguaccagcuggacgagcugcucaauuuucggauccccuacuacguggggccccuggugacggcgaaagaacagaaggccgcccagggcggcgucuucgccuggauggugcgcaaggacccugaugggaacaucacgccguacaauuucgacgagaaggucgauagggaggcguccgccaacaccuucauccagcgcaugaagaccaccgacaccuaccuaaucggcgaggacgucuuacccaagcagucccugcuguaccagcgguacgaggugcuuaacgagcugaauaacguccgcgugaacaacgagaagcuguccaucgagcaaaagcagcaggucauccgggagcuguuugagagacacaacagcgugaccaucaagcaguucgccgagaaccuucgggcccacggggacuacgcccacauccccgagauccgcggcuuggcggacgagaagcgguuccucuccagcuuguccaccuacagacagcucaagagccugcugcccgacgccaucgacgacccugccaagcaggccgacaucgagaacaucaucgcgugguccacgguguucgaggaugccgccaucuucaaaaccaagcuaaaagagaucaacuggcucgacucacagaccaucaccaagcuguccaacauccgcuaccggggguggggccaauucagccacaaguuccugaacggccuaacccuggggaacggccacacgauaauccaggagcuguuccucucgaacaacaaccugaugcagauccugaccgacgagacccuccagaagaagaugaccgagcugaacgccgacaagcugaaggcagccaacauaaacgacgccaucgacgacgccuacaccagccccuccaacaagaaggcgcuccgucaggugcugcgcgucaucgaggacaucaagcgcgccgcggacgggcaggacccaagcuggcuguacguggaaaccgccgacggcgggggcacccccggcaagcgaacgcgcgcccggcaacaccagcuccaggagaucuacgccaacgccgcccaugagcugaucgacuccgccgugcgcggugagcucgaggacaagauugcggacaaggccgacuucaacgaucggcucguccuguacuucaugcagggcgggcgagacaucuacacgggcacgccgcugaacaucgaccagcugucuuccuacgacaucgaccacauccugccccagagccugaucaaagacaacagcuuagacaaccguguccuggugcacgcgaucauaaaccgcgagaagaacgccaccuucgccucaaccaucuacgcccagaaaaugaacgcuacguggcggcaauggcacgaggcgggcuuaaucaguggucgcaagcuccgaaaccugcaaaugcgccccgaccagaucgacaaguacgcuuccggcuucgucgcccggcagcuaguggagacccgccagaucaucaagcucaccgagcagaucguggccgcccaguauccggaaaccaagaucaucgcggucaaggcgggacuaagccaccagcugagagaggagcucgaguuccccaagaaccgcgacgugaaccacuaccaccacgccuuugacgccuuccuggcugcgcggaucggcacguaccuacucaaacgcuuccccaaccugcaggccuucuucaccuacgggaaguuuaaaaaggccgacgugaagaagcugcgcggcuucaacuucauccgggauauaacccacgccgaggacaaaaucgucgugaaggacaccggggagguuaucugggacaagaagagagacgucgacgagcucgacaggauauacaacuucaagcgcaugcugauaacgcacgaggugcacuucgagaaggccgaccuguucaagcagaccguguauggggcgaaggacuccaaggaagccggcgggaaaaagcagcucauaagcaagaagaagggcuaccccgucgacauuuaugggggcuacacccaggagaccggcuccuaccugucuguggugcggcugacgaagaaggccauguacgcggucguaaagguaucuacccgagacgcggccaagcuagccgucgccaaaagcaucuccgagcagaaggagaacgagacccugaacgacaucaucgacgagaagcugucgaagaucuccaagaacggaaagaucacccacgaguuauucgaggucguccucccgcgagucgggcagaagacgcuguucaagaacagcaaguacaaccucuuccuggugaacuccgacaccuacaugcacaacuaccaggaacuguggaugccacgcgaguaccagaagauguggaaggacauaagccucucuaaguacggggaugcccagaccgaggaccagcuggaccaaaucuucggcuuuaucgugagccaggucaacagcuacuucaaccuguacgacaucaaccaguuuaggaagaaacucaacgacgcggccgacaaguucgccacccugccaaugagggacacagacgacaugcagggcaagaucgccaccaucggccagcugcucauuggccugcaggccaacgcggcccgguccgaucugcgcaaccucgacaucaagacgccccuugggcugcuccagaucccgaacggcaucagucuggacuccgauaccagcguuguguaccagucccccaccgggcugcucgagcgggagguccaccugagcgaccuguga

SEQ ID NO: 7875 - RNA, 4170 nt, Artificial Sequence
  Cas9 variant
auggcgcgcgacuacagcgugggccuggacaucgggaccuccagcgucggcugggccgcuaucgacaacaaguaccaccucauccgggccaaguccaagaaccugaucggggugcgccuguuugacagcgccgugaccgccgagaagcggcgcggcuaccggacgacccgccggcgccucucccggcgccacuggcggcugcgccugcucaacgacaucuucgccgggccccugaccgacuucggggacgagaacuuccuggcgcggcucaaguacagcuggguccacccgcaggaccaguccaaccaggcccacuucgccgcuggccugcuguucgacagcaaggagcaggacaaggacuucuaccgcaaguaccccaccaucuaccaccuccggcuggcguugaugaacgacgaccagaagcacgaccuccgggagguguaccuggccauccaucaccuggugaaguaccgggggcacuuccucaucgagggcgacgucaaggccgacuccgccuucgacgugcacacguucgccgacgcgauccagcgcuacgccgagucuaacaacuccgacgagaaccugcuggggaagaucgaugagaaaaagcucagcgccgcccugaccgacaagcacggcuccaagagccagcgggccgagaccgcggagaccgccuucgacauccuggaccuccaguccaagaagcaaauccaggccauccucaagagcguggucgggaaccaggccaaccugauggccaucuucggccuggacuccagcgcgaucuccaaggacgagcagaagaacuacaaguucagcuucgacgacgccgacaucgacgagaagauugccgacagcgaggcccugcuguccgacacggaguuugaguuccucugugaccugaaggccgcguucgacggccugacccucaagauguuacugggggacgacaagaccgugagcgccgccauggugcgccgguucaaugagcaccaaaaggacugggaguacaucaagucccacauccgcaacgccaagaacgcgggcaacgggcucuacgagaaguccaagaaguucgacggcaucaacgcagccuacuuagcccugcagagcgacaacgaggacgaccgcaagaaggccaagaagaucuuccaggacgagaucagcagugcggacauccccgacgacgucaaggccgacuuccucaagaaaaucgacgacgaccaguuccugcccauccagcggaccaaaaacaacggaacgaucccgcaccagcugcaccgcaacgagcucgagcaaaucaucgagaagcaggggaucuacuaccccuuccugaaagacaccuaccaggagaacagccacgagcugaacaagaucaccgcccucaucaacuuccgggugcccuacuacgugggcccccuggucgaggaggagcagaagaucgccgaugacgggaagaacaucccggaccccaccaaccacuggauggugcgcaaguccaacgacacgaucacccccuggaaccuuagccagguggucgaccucgacaaguccggccggcgcuucaucgagcggcuaaccgggaccgacacguaccugaucggcgagcccacccugccgaagaacagccuccuguaccagaaguucgacgugcugcaggagcucaacaacauccgcguguccggccggcgccuggacauccgggccaagcaagacgcguucgagcaccuguucaagguccagaagaccgugagcgccaccaaccucaaggacuuccucgugcaggcaggguacaucuccgaggacacgcagaucgaggggcuggccgacgucaacgggaagaacuucaacaacgcccucaccaccuacaauuaccuggugagcguccugggccgcgaguucguugagaaccccuccaacgaggaacuccuggaggagaucaccgagcugcagacgguguucgaggacaagaagguccuccgacgccagcuggaccagcuggacgggcucagcgaccacaaccgggagaagcugucccgcaagcacuauaccggcuggggcaggaucagcaagaaacugcucaccaccaagaucgugcagaacgcggacaagaucgacaaccagacauucgacgugccccgcaugaaccaaagcaucaucgacacccuguacaacaccaagaugaaccugauggagaucaucaacaacgcggaggacgacuucggaguccgggccuggaucgacaagcagaacaccacugacggcgacgaacaggacguguacucccuaaucgacgagcuggccgggcccaaggagaucaagcgcggcaucgugcagagcuuccgcauccuggacgauaucaccaaggcggucggguacgccccaaagcggguguaccucgaguucgcccgcaagacccaggagucccaccugaccaacagccggaagaaccagcuguccacccuccugaagaacgccggccugagcgagcucgugacgcaggucucccaguacgacgccgcggcccugcagaacgaccgccuguaccucuacuuucugcagcagggcaaggacauguacagcggggagaagcugaaccucgacaaucuguccaacuacgacaucgaccacaucaucccucaggccuacaccaaagacaauagccuggacaaccgggugcucguguccaacaucaccaaccgccgcaagagcgacuccagcaacuaccugcccgcccuaaucgacaagaugaggcccuucugguccguccucagcaaacagggccugcuguccaagcacaaguucgccaaccucacccggacgcgcgacuucgacgacauggaaaaggagcgguucaucgcgcgcagccugguggagacccggcagaucaucaagaacguggccagccugaucgacucccacuucgggggcgagaccaaggccgucgcuauccgcagcucccucaccgccgacaugcggcgcuacguggacaucccgaagaaccgggacaucaacgacuaccaccacgcguucgacgcccugcuguucagcacggugggccaguacaccgagaacuccgggcucaugaagaagggacagcugagcgacuccgccgggaaccaguacaaccgcuacaucaaggaguggauccacgcggcgcggcugaacgcccaaagccagcgcgucaaccccuucggcuucguggugggguccaugcggaacgccgccccaggcaaacucaaccccgagaccggcgagaucaccccggaggagaacgcagacuggagcauugcggaccuggacuaccugcacaaggucaugaacuuccgcaagaucacggugacccgucggcucaaggaccagaaggggcagcuguacgacgagucccgcuaccccagcguacugcacgacgccaaguccaaggccucaaucaauuucgacaagcacaagcccgucgaccucuacggcggguucuccagcgccaaacccgccuacgcggcccugaucaaguucaagaacaaguuccggcuggugaacgugcuccgccaguggaccuacuccgacaagaacagcgaggacuacauccuggagcagauccggggcaaguacccgaaggccgagaugguccugucccacauccccuaugggcagcucgugaagaaggacggcgcccuggugacgaucagcagcgccacggagcugcacaacuucgagcagcuguggcugccccuggcggacuacaagcucaucaauacccugcugaagaccaaggaggacaaccucgucgacauucugcacaaccgccuggaccucccggagaugaccaucgaauccgccuucuacaaggccuucgacagcauccuguccuucgccuucaaccgguacgcccugcaccagaacgcgcucgugaagcugcaggcccaccgcgacgacuucaacgcccugaacuacgaggacaagcagcagacacucgagcggauccuggacgcccugcacgcgagccccgccuccagcgaccugaagaagaucaaccuguccagcggcuucgggaggcuguucucccccagccacuucacccucgcggacaccgacgaguucaucuuccaguccgugaccggccuguucagcacgcagaagaccguagcccagcuguaccaggagaccaaguga

SEQ ID NO: 7876 - RNA, 4170 nt, Artificial Sequence
  Cas9 variant
augaagaacuacaacaucagccuggugcccuccccgagcggcgucggguacgccgugaccgacgacaaccucaacaucaucaagcccgugcaccacgucuccggcauugggagccgccuguucaacgagggcuccagcaagcaggaucggcgcaacucccggagcgccagacggucccgccaccggcagcaggggcgcaucaaggcgcugaacagcaucaugaaggacgagaucaucaagguggaccccacauucuucgaccggcucuaccaguccgagcugagcccccuggacaagaacaagaaguaccgcaacaucaucuucgacaagccguccguggagagcuacuacuacaagaaguuccccacgaucuaccaccucgagaaauaccugaucaacaccgacgggaaggccgacauccggcugaucuacugggcccuccacucccugcugacccaccgcggccacuucuacaacaccacgcccgucagccaguucaaacccggggcccucaacauaaaggacaaguucaucgagcugaaccagcugaaccaggugaagaccuucgaguucuccguggccaacaccccggagaucgagcacauacucaaggaccgguacaucagcaagcagaacaagaucaaccagcuggcggagcuccucuucgagcaggagcccgaaaaggacauccagaaggccaacaccaaggucgccaagacgaucgccaaggcgauucugggcaacaaguuccagcuggacgagaucaucgggcucgacgugaacaaguccgagaagaaggaguggagccugcagcuguccgaccucaaccuggacuccaagaucgacgagcugagcgacuccuugaccgaccagcagcugcgcauccuggagauccuccaggagauguacgcggccaccacccugcuggacauccuccaggggagcgauucccugcuggacgccaagaucaagagcuacaaugaguacaagcagaaccggcuccuguucuucgaucuccucaagacgcugcccgacaagaaggcgcaccuccugcgccagggguacacccuuuaccugaacaaccaccaccgggaccucgcguccgcccgcaaggaccugggcaucguggccgcgaccaacuucagcaagaccgaccuguacgcccucaucaagaagacgcugaaggacgagcccgagaccccagaguccaagaagguccugggccugaucgacaagggggaguuccucaacaagcagcggaccgaccugaacaccuacauaccguaccagcugaacgcgcucauccugaacaaaauccugaagaaccagggcaagcacuaccccuuucucaucaaggaaaacccugccgagccggaccgcaaggaggcccccuacgagaucagccagcugaugcaguucacgauccccuacuacugcgggccccuugccaccccggaggagcagaaaaaccuccccgaguccagccgguucggcuggcuggugcgcaaggaggagggacgcaucacccccuggaacuucuacaacaagaucaacgugauagagaccgcgaacgcguucaucaagcgguccaucgggaaggacacguaccugcucagcgagcccguccugccggacaacucccugcucuaccagaaguacaaagugcugaacgagcugagcuccaucagccucguggacgccaacaccaagaaggagaagaagcugacggccaagaucaagcagcugcucuacaaggagggcuucaagaagcacgucaccguguccaagacgauggcccugaagauccugaacgacaacaacguucccaccagcgacauccucggguugagcaccggcaagaaguucgacaacucucugagcaccuauaacuccuggaaaaaggccuuccccgagcagaucgacaacccccacuaccgacaggaccucgaguacaugaucgaguggagcacggucuucaccgaccggaagauccugguggagaagcugaaagagaucgaguggcuccgcccggagcagaucaaguucgugcuggagcaccggcugaccggguggggcaagcucuccaagcgccugcuggucgagcucaaggacaacaagggcaaaagcaacaucgacaaccuguucaacaccaagaagaacuucaugcagaucguuucccagcaggucuacaacacgcagaucgaggcgaucgcccugaagaccaccaagaaccagagccucgacaacauccuggaggccgccuacaccucccccgcgaaccggaaggccauccgccagaccaugaagguugugaacgagaucgucacgcuggccgggaagggcacccaccccgacaagaucuuccucaccuuccagcggucuaaagaacaggaggggaaacugaccacggaccgcgccuccagccugcucaagaucuaccggggcauaaaggacccgcugugcaccaaggagcugguggaugagcucuccaagaacgugcgcgccaacuuaaucaagaccaaggaguaccuguacuaccagcaacucgggcgggacgcgcugaccggcgagaucaucgacaagacggaccugcgcaacuacgccguccuccacaucaucccccggagcgugguggucgacgacuccaucaacaaccuggugcucaccaaggugaagaacgcgaaggagagcaucgucgugcaguacggauccaagaacaucagcgacaucagcauguccgugaaggauuucuggaaccgccuccagaagcuggggcuguucagcaagggcaagcuccggaaccugaccaccgaccugacggagcucaaccaguacgagaagcagggguucaucgcccgccagcugguagagaccaaccagaucgugaagcugcucgccaccauccugcagggccaguucccgcacaccaagaucaucgaggugcggcaggagcagaucgcgaacauacgcuaccagcuggacaucuaccgccuccgcgaccugaacgucuacuaccgcgggauggacgccuaccuggccgccgugguggguacguaccucuacaccgucuacccgaaggcccggcgcuucuucguguacggcaaguaccugaaacaagacaagaacaaccgggaggaggggcaauucaagaccuccgggcacagcuucaauuuccuguggaagcuguucuacgggggcgaggacgagaucuacgugcagggcaccaacaacauugcguucaacaagaaggaccugcugcagaagauuaaggaggucaauaacuacaaguuccagaacgugucccucgccacggggacacgcagaagcgaccuguucaagcagaccaucuacccgcgccaggagcgcgacgucaagaagucccgcacccugaucacgaagaagaacggccucuucaccgacaucuacgggggcuacaccgggaacgucaacagcuacuucgugcuggugcagaccaaauacaagaaggaccccgacaaguucaaucuguacggcguccccaaccgguacguggccaugcucgagcaguccaagagcaagggcaacuacgagacgaagcugaaggaggugauggagcccaucaucaaaaauuccaacaagcgcaugaucggguacaagauccugaaggaccggauccucuacaaccagaucaucgaggacaacggguauaaguucuucaucaccagcucccaguaccgccacaacuuccggcagaugaucuugagcgaccaauccaagaagauccugauggacuacgucuucgacccgaacuucuaccgccacaagaagaccgaggacgugaacaacgacaaggacgccaaguugaucaagguguacgacgagauccuguaccagaucgaccacuaccugcaaaucuucaccaucgggcaccacaucgauaagcucaagaaggcgcggcccuuguuugagaagugcacgcuggccgagaaggcccagguccugaacgacauccucaucaucgccggcagcaaccagaccgagcuggcccugaagccccucaagaccaccaagcugacguucuccaagcagaacugcccccugaccaaggacgcgaucuucuacuaccagagcccgaccgggaugaucacccgcaaggaauccaucaaggacauccucaagcagaacaucuga

SEQ ID NO: 7877 - RNA, 4173 nt, Artificial Sequence
  Cas9 variant
augucaaggaaaaacauugucgaggacuacgcuaucucccucgacauaggaaacgcaagcguaggguggguagccuucacccccaacuacaggcucguccgggccaagggccacgaacucauuggcgcccgucucuucgaaccagccucaaccgcggaagaaagacgaauggcacgaacaacgcgacgacgcuacagucgcaggcgauggcgccuacgcaugcuagacucgauguucgaccaggcucucuccgaaguugaccccagcuuccuaaugcgacgcaaauacucauggguacacccggaggacaagaacaacgaggcacacugguucggcggaguucuuuucgacucaaacgaacaagacaaaagguuuuacgagaaauaccccacuauauaccaccuucgaaagagccucauggaagacgacgaacgacacgacauaagagaaguuuaccuggcgauccaucauaugaugaaauaucgaggaaacuuucuaaccgaaggagaacucgccccauccucagucuucgaugucgaagacuuccucaaacuuuuaacggaaauccuccaguacgcagaugaaggcgagacggacgaagaucucgaacuucaagcagacgcaaacgggcuaacagaagcacucuguaccaccaagggaucccggucgauaagggcgaaaaacgcgaucagcauacucaaagagggagcggcgcucuccaagcgucaagaggcaauaaucuccgcuguuuucgccgggcuagagggcaacaagcuggaccucaccaaaguauucccgaacaaggaauacacccccgaagacaaaaagacccuggcgcucuacuucaacaaagccgauuacgacgaaaagagagucgcgaucggagacaguggguuacucgaagacaacgaaugcgauuuucuagacugcauacgaagacaguacagcgccaucgcacucaaacaacucuugggagacuucacaaguaucagcgagaguaugugcgcccgauacgaacagcaccagcgcaauugggaccuaauaaaacgcuauugccgggaagagucgaacgccgagaacauaaauaagaacuacggugcgcucgucggcugggaaauaguagggggacaacggcgcuccaucagaggagcgaaagacuacgaaaacaaaaggaaggccgcaaacaaauucuucgaggaacucaucaaaggauccgcccuccccgaccaagagaaagaaaggcugcuccacgacaucgaaaacgacgaacucuuccccgugcagcgagacagcggcaacggaguuauccccuaccagcugcaccugaacgagcugaagaaaauaauacaaaaacaaggacgauacuaccccuuucuacucgagacuuacaucaaagaugggaaagaggucaacaaacuugaagggcuccucgccuuuagagucccauacuacguaggcccgcuaguaagucgagacgacaugcaauccucggacaacagggaaaaccauuggaugauccgaagaaagaagggugugaucaccccauggaacuucgacgaaaugguagacaaggacaaaucgggacaugaguucauaaaaucgcucguaggaacugacagcuaccuauuaggagaaacaacccuccccaagaacagccuacuguaccaagaguucgagguacucaacgaacuuaacaacguucgucuaagcauacgcaccggcaaccacugggccgacaaacgcagaguccgguugggacacaacgaaaagaagcuacuccuagaggaacucuucgccaaacaggccacagugacaaagaaagccgcugaaaaccuccuaagacgaaccuacggcaacaccuacgagauuuccgggcuggcagacgaaaagaaauucgucagcucccuuucauccuacggaaaaaugugccgaacacucaaggccaguuacguaaacagccacaaagacguaguugagaaaaucauugagcuacaaacaguauucgaagacaagaaaacacucaaacaccaacuucagcuucucggcgagcuggcggaaaccaacugcgaacuacucagcaacacacacuacaccggcugggggaaacucagccguaaacugcucacauccaaaguagucgucugcaagauaggaaacgacuucgcccccgcaaaacacagcauuauagaaauaaugcgcgagaccgaccgaaacuucauggaaaucaucacggauaaagacuuaggaguaggagaguggaucaaccaacagaacguuggcgccgaggacggcaacuccuaccaagacaucaucgacgaccuccgcgugucaccaaagguaaaacguggaauuaaccaagccaucagaguuauugaugacaucucuaaagcugucggaaaggagccaagccgaaucuuucuagagcuggccggcgacguccagcaaagcgcaaggaccgucaguaggaagucccgacuccaaggguuauacaaaagcgccggccuacagaaagaguuccgagaccuagcugaaucccuaaacgaauguucagacaacgaccugcgagacgacagacucuuccuuuauuauacacaacuuggaaaagauauguauaccggcgaaccacuaaaccuagaccggcuuagcagcgacuacgacaucgaccacaucauuccccaagcggugacgcaaaaugacagccuggacaaccgcguccuaguagcaagaguagcaaacgcgcgcaaaacugauagcuuucaauaucuccccgaaauugcgaaucggaugaggaacuucuggcaagaacuauuagacgccgggcuaauaagccgcgugaaauucgacagacuuaacagacagaacgacuucuccucccaugaaaaggaacgcuucguacagagaagccucguagagacacgacagauuaugaagaacgucgcaacaauuaugcgcaaaagauacgggaacagcgccgcgguaaucggacuuaacagcgaacuuacgaaagaaaugagacaguacuuaggauucagccacaaaaaucgggauaucaacgauuaccaccacgcccaggacgcgcuuugccuagggaucgccggacaauucgccgucaacagaggauuuuucgccaacggcauggucagcgacggugcggugaacaguuacaaucuauaucugcaagauuaccuccgcggcuacagagagaaaaugucagccggcgaacggaggcguaauaaggccuucggauucaucguaggcagcaugaacagucaagacucggacaaacgaaucaaccccaaaacaggagaaaucgcaugggacgacgaggacaagguauaccuacggaaggucaugaauuaucgaaaaauguugaucacacaaaaggucggagacaguuucggcgcauuauacaacgaaacgcgauacggaaccagcgccaaggaaggggucaaugggauaccguucgacaaacacaagcaagacaccgcgcuuuacggaggcuucagcuccgcaaaaaccgucuacgugguccucauagaggccaaaaagaaaaccagacuggucaacaucacuaugcaagaguacgcagagcugggggaccaccccagcgacgacgcccuacgcgcaguguuagcaaagaagaaaccagaauacggaaaagcgcggauacuacuccgacacauacccccaaugcaacuuauucgauauggaggugcgcuaguaacagucaaaucagcgacagagcucaauaacgcacaacagcucuggcuccccuacaaagaguacugccucuucgacgacguaauuucuagcgcgaucgacgucgacgaggcccgccucugccagaugcuagacgugauccuggacgccauccagaaguacuaccccaaacaaagauucgacgagacugggcugagcgccuuccacaaugcauucaacgaaguaagcgccgaagacaagaaaagaaucgucggcgaaauggugggaaugcuccaugcagacgccaaaaaugcgaaccucaaggcucucggcaugagcggaagguggggccgaaugagcaaucagaguggcuacaccuucgccgacagcgaugaguucaucuuccaaagcccuucggggcuuuucgaaaagagaauuagugugggagaacucaaaaagaggagggcacgcuga

SEQ ID NO: 7878 - RNA, 4173 nt, Artificial Sequence
  Cas9 variant
augaaggaggugaaggacuacaucaucggccuggacaucgggaccaacagcugcggcuacgucgugaccgacaagcaaaacaauauccucaagcugaaggggaagacggccaucggcgcccgccuguucaaggaaggggaggcggccgccgaccggcgcgccuuuagaaccacccgccggcgccuggcccggcgccgguggcgccucggccugcucgaggagaucuucgacgaggagauggcgaagguggacuccagcuucuuccggcgccuuaaggaguccgacuacagccccaaggacucccggaagcaguucaacucaaucgucuucgaguccagcgaagccgacaaggacuucuaugacaaguacccgaccaucuaccaccuccgcaacgcccucaugcacgacgaccagaagcacgaccugcgggagaucuuccuggccgugcaccacaucgugaaauaccgcgggaacuuccuccgggaggacuccgucaaggcguucaaggccgccaaguucacgcugcagggggaggauggcaucgggccaguggacaagcugaacgaccuccugaaggagaucuacaucgaggccgcccccgagcuggcgaccgacaaccucagcaagaucgaggagaucaucaaggacaagaagcuguacaagcaggacaagcugaagcaggucgccacccuccugaccaaggaggccgacacgaaggacaaggccaagcugaacaaggacguggccaagcaggucgcgaacgccuucaugggcuacaugaucaucuucgacaccaucuucaaccucuccgacguggacagcaaggacuacaaggugaaguucuccgacgccaacaucgacgagaagcuggacacccugaccagccuccugacggacaagcagaccgaguucgugcuggagcuccagaacaucuacaacaccaucgugcugaacgagaucguccccgacgggaagucccugagcgaguccauggugaaaaaguacgacgaccacaaggaggaucucaagcuguucaaggccuaccugaacagccucaccgacgugaagaagguaaaagagcugaaggccgcguacgugcuguacgugaacaaccgcaaggccaaccuccuggccgccaagaagcugcucggcaagaaggccgacaacaugaacaacuucgagaucuucucgaaguucgucgcggacaaccuggacgacagcgagcuggccaacaagauccgggcccgccucgaccugggcgaguuccugccgaagcagcgcacgaaccagaacggggucauccccuaccagcuccaccagguggagcugacccagauccuggagaagcagggaaaguacuaucccuuccugaucgcccccaacccggucgaaucacaccgcaacaacgcgcccuaccgcaucuccgaacucgugagcuuccggguccccuacuacguggggccccugaucgacccgaacaacgcugaguccgagcaggacaaggccaacucauccuucgccuggauggugagacagaagcagggccagaucacccccuggaacuucgaggagauggucgacacgacggagagcgccaacaaguucaucaagcggaugacaaccaaggacaccuaccugcucggcgaggacguucugcccgcuuccagccugaucuaccagaaguucgugauccucaacgagcugaacaacaucaaggucaacgggaucaagcugacguccgaggagaagcaccagauuuucgacgagcuguucaaggugcagaaguccgugagccugaagaaccuggucaacuuccucaccgcccacggcugcguggcccccaacgugaccggucuuagcgacggcaccaaguucaacuccagcuauuccacguacaucgacuaccgcaagaucuucggcgccgagaucgacaacaaggacaagcaggccgacuucgagaagaugaucgaguggagcaccgucuucgaggaccggaagaucuucaagcggaagcuggaggagaucacauggcucaccccggaccagaucaagcaggucuccagcaagcgguacuccggcuggggccgccugagcaagaaacuucucacgcagaucaccgacgagaacggggugaacauccugcagcggcuguggaacgagagcgagaaccucaugcagauccuguccgaccccgugaucaaggaaaagaucguagcggccaacagcuccuucaccaaggccaccgacauggaggauauucuggccgaggccuacacgagcccccagaacaagaaggcuauccgccaggugaugcgggucgucgacgacaucaucgccgccgcccacggcaagaagcccucccagaucgcgaucgaguucgcccgcgaggaccaggacaacccgcaaaugaccaagagccggaaggcccagcucgaccaaaucuaugcuaagaucagugacgaguuccuggacaacgccgugaagaacgagcugaagaacaugaaggacaacaagccccucgcgaaggacaaggucuuccuguacuucaagcagauggggcgcgacgccuacaccggcgaaaagcugagccucgauaaccugcaggacuacgacaucgaccacaucuacccccaguccuucaucaaggacgacagcuucgacaaccgggugcuggugcagcgcgcugucaacaacgggaaguccgacaacgugcccgugcuccuguucgggaacaaacaggccgccgaccugggcaugaccauccggcagauguggaagaaguggcucgagcuggggcugaucagcaagcgcaaguucaacaaccucaucaccgacccggagaagaucuccagcuacauggcguccggcuucgucaaccggcagcugguggagacgagccaggucaucaagcuggucgccaacauccuccaggccaagcugcccgacaccgagaucaucgaggugaaggccuccuacaacagcauccugcgcaaggaguucaaccucuacaagagccgcgaggugaacgacuaccaccacgccaucgacgcguaucugacuaccaucgucgggaacuacuuauaucagguguaccccaagcuccggcccuacuucguguacggccaguucaagaaguucgggaaggccgaguccaaggaggacgacccggucaagaagaucaagcaguucaacuucaucuaccagcugcuguggggcaaggacgacgccaucugcaucagccacacggaccagcaggucuucucccgcagcgacaucaucaacaagcucaccaccgccuacaacuucaaguacaugaacgugucccaggagguguacaccaacagcaacaacguguucaagcagacgguguuccccaucaucgagcgggacaccgcgaagucccgcagccugauccccaagaagcuggaccggccgaccgacaucuacggcggguacuccaacaacaacgacgcguaccucgcccuggucaagguggacaagaagaagggcagcgaguaccgcguggucgggauccccaugcgggccgccgcgaugcugaaggcauccaagaacuaugacgaggaccuccgcaaggugaucgagcccauggugaugcuggacaagaacggcaaggccaagaggggcaucgagggguuccgcguccuggugggcaagaugcccuucaagcaggccgugcucgacggggacaagaaguucaugcugaccggcacgaacgacaugccgaaccugaagcagcucguccucagucagcagaacaugaaguacauccuggacuacaucgacgacaucgacugccggaagcacaaguucgggaacaagacccaggacggcaacaagugccuccuggagguguucgacgagaucauccagaucgucgacaagcacuucgagcuguucgacaacagguccuuccgggagaagcuccgcaacagccgggugaacuucaucaaccuggcccuguccaagaaggcggaagcccuccuggccauccugaacggccuccacgccaacagcaugcguaccaccaucaaggagcugaagaucuccgaccuggggcggauacagagcuccgugaucucgcccgaggcccagcucaucuaccagagcccgacgggccuguucgagcgccgggugaaggugaaggaccuguga

SEQ ID NO: 7879 - RNA, 4176 nt, Artificial Sequence; identical to SEQ ID NO: 2079
  Cas9 variant

SEQ ID NO: 7880 - RNA, 4176 nt, Artificial Sequence
  Cas9 variant
augaaggagaucaaggacuacaucaucggccuggacaucggaaccaacagcugcggcuacguggucaccgacaagcagaacaacauccucaagcugaaggggaagacggccaucggcgcccgacuguucaaggagggggaggcggccgccgaccggcgcgccuuccggaccacccgccggcgccucgcccggcgccgguggcgccugucccuacuugaggagaucuucgacgaggagaugaacaagguggaccccagcuucuuccggcgccugaaggagagcgacuacagcccgaaggaccggcgcaagcaguucaacuccaucguauucgaaagcagcgaggcggacaaggccuucuacgagaaguaccccaccaucuaccaccuccggaacgcccugaugcacgacaaccaaaagcacgaccugcgcgagaucuuccuggccguccaccacaucgugaaguaccggggcaacuuccuccgcgaggacagcgugaaggcguucaaggcagccaaguucacucugcagggcgaggacgggaucggccccgucgacaagcugaacgaccuccugaaggagaucuacaucgaggccgcccccgagcuggcgaccgacaaccucuccaagaucgaggacaucaucaaggacaagaagcuguacaaacaggacaagcugaagcagaucgccaaccuccugccgaaggccguggacagcaaagacaaggccaagcugaacaaggacaucgccaagcagguagcgaacgcccucaugggguacauguuccggcuggacacccuguucuccuucaccgacguggacgugaaggacuacaagcucaaguucucggacgccaacaucgacgagucccuggacgcccugacgagccuccugaccgacgcccagaucgaguucgugcuggagcuccaguccaucuacaacaccauaguccugaacgagaucgugcccgacggcaugagccuguccgagagcauggugaagaaguacgacgaccacaagaaggaccucaagcuguacaaggaguacaucgacucccugagcgaccagaagaaagcgaagcagcucgaggccgccuaugcccuguacgucaacuaccgcaaggccgaccugcucgcggcaaagaagcuguucgagaagaagaaaaucggggacaagaaguucguggacgucaucagcaacuucgagguauucggcaaguucgugagugacaaccuggacgacagcgagcuagccaacaagaucaaggcccggcuggaccugggcgaguuccuccccaagcagcgcaccaaccagaacggggugauccccuaccagcugcaccaggucgagcugacccagauccuggagaagcagggcaaguacuacccguuccucaucacccccaaccccguggagucccaccgcaacaacgcgcccuacgagaucagcgagcugguguccuuccgggucccguacuacguggggccccugaucgacaaccagagcaucaaggacaagcagaacaagaacaaguucgccuggaugguccgccaaaagcagggccagaucacccccuggaacuucgaggagaugguggacaccacggaguccgccaaccaguucaucaagcguaugaccagaaaggauaccuaccuccuggccgaggaugugcugcccaagagcucccucaucuaccagaaguuuaugauucuggacgagcugaaccggaucaagaucgacggcaagaagcucaccagcaagcugaagcacgacaucuucgagaagcuguucaagaagcagaaguccaucaaccucgacaaccugaagaauuaccugcucgccgaggggaacaucccgggccugaucgaggggcuaagcgacggcaucaacuuuaacaacuccuucagcacguacaucgacuauaggaacaucuucggggacgagaucgacaaccccaacaagcaggcggacuucgagaagaugaucgagugguccaccgucuucgaggaccggaagaucuucaagcgcaagcucaaggagaucacuuggcugacccccgagcagaucaagcaggucagcuccaagcgauacagcggcuggggccgccuguccaagaagcuccugacgcagaucaccgacgagaacggggugaacauccugcagcggcucuggaacgagcccgagacccugaccgaggugcuggccaacccggugaucaagcgcaagaucagcgaggccaacagccucuucgugcagaucaacaaggucgagaacauccuggacgacgccuacacgagcccccagaacaagaaggccauccgccaggugauccggguggucgacgacaucaucgcggccgcccacggaaagaagcccagccagauagccaucgaguucgcccgguccagccaaaacaaggcgaaggugcccgacacccgcaagaagcagcuggacaagaucuacaacaagaucuccagcgaaauccucgacuccuccaucaagaacgagcugaagaaccugaaguccaacaaauaccucagcaaggacaaacuguuccucuacuucaagcagauggggcgggacgccuacaccggagacaagcucucccuggaccagcugcagaacuacgacaucgaccacaucuucccgcgcagcuucaucaaagaugacucccucgacaaccgggugcugacccagaagccaauaaacgccaagaaguccgacuacgggauccccgcccuggaguucggcaacaaguacguccccgaccucggcaucacggugaaggagauguggaagcuguggcaggagaacggccugaucaguaagagcaagcucaucaaccugugcaccaacccgaagaagaucggcuccaagagggcgucaggguucauaaaccgccagcugguggagaccagccaaguuaucaagcucguggcuauaauccugcaggccgaguuccccgacaccgagaucaucgaggugaaggcccugcagaauacgacccuccgggaauccuuccaccuguacaagaaucgcagcgucaacgacuaccaccacgccaucgaugcguaccucaccaccaucgugggcaacuaccucuaccagguguaccccaaacugcggccguauuucgucuacgggcaguucaagaaguucaaucaggagaagaauaucgacauccugaagcggcuaaagaacuucaacuuccugcggcagcugaucuucaacaccgacgacaacaucuacaucuccggcacgaaggagaucguguucaacaagaaggacaucauccacaagcucgaaaccgccuacggcuacaaguacaugaacaucagccgcgagugcuaccaggagaccuccucucuguucaaccagacccuguacgcccacaacagcagcgugaagaacucccucauucccaagaagaaggggcugcccacggagaucuacggcggguacucuggcaacaaggacuccuucuucguccuggugaagaucgugaagaagcggaccaaccucuaccgcaucgucggcauccccaccagagagcuggccaagcugaacagcuccaacaacuacaaccaggcccucaacaagaucguggagagcaagcugugccugaaggagaccgaguccuucaagauccucaucaagcgccugcuguacgggacgcucaucguggacaacggccagaaguuccggaucgggagcuucaaggagaagcacaacguccagcagcuggugcugcagcucaaguccaugaaguacaucaaguucuacaucgauggcgggcagaacuacuucacagacguggagcgcaagaagcuggagaagcaggaccgggacaagugccugcucuacgucuucgacgacaucaugaacguggugaacaagcgcuucacccuguucgacaugagcaaguacgagaaggacggcgacucccugcgggagaaguucaacugccucgacuucaacgacaagguaaguauccugagcgaccugcucaaagcguuccacgccaacuccgaccgcaccagcaucacgaagcugaagaucaccaaccugggccggcaccaggccgggaagaacggcaucacccucaccacgaacgcccagauaaucuaccaguccccgaccgggcuguucgagcgccggaucaagaucaaggaccuguga

SEQ ID NO: 7881 - RNA, 4176 nt, Artificial Sequence
  Cas9 variant
augaagaagauccugggccucgaccuggggaccaacagcaucggcugggcccuggugaacgaggccgagcacgagcacgagcaguccagcaucgucaagcucggggugcgcgugaacccccuguccgucgacgagaagaccaacuucgagaagggccggccgcugagcaucaacgcagaccgcacgucuaagcggagcgcccgccggaaccuccagcgcuuuaagcugcggcgcaagaacuugaucaaccuccugcugaagcaccacaucaucuccaacgagaccauccucaccgagguggggaagaacaccacccaccagacccugaagcugcggagcaaggccacccaggagaagaucagucucgaggaguucgcccgcauccugcugagcaucaauaagaagcggggauacaaguccagccgcaaggagaaaaacgaggacgagggcuucaccaucgacgggauggccaucgcgaaggagcucuacgacaaccagcugacgccgggccaguacguguacaacauccugcaggacgggaagaauuacauccccgacuucuaccgguccgaccuccaggccgaguucgacgacgucuggcaguuccagaagaaguucuacagcuccauccugaccgacgaguucuaccugaagcucaagggccaggggaaggagaacacccgcaagcuguuccuggccauccaccagguguacaccgccgagaacaagggcaagcgggacgcggugaagcuccaguacuacaaguggcgcagcgaggccgucaagaagcaacuguccaucgaagagguggccuacgugcugguggagaucaacaacaacaucaacaagagcuccggcuacuugggggccaucucggaccggagcaaggcccuguacuucaacaacgagacggugggugaguaccuguacgggcagcucgugaagaaccgccacaacucccugcggaaccaggucuucuaccgccaggacuaccuggacgaguucgagaagaucugggagacccaggcgaaguucuacgaugagcucaccaacgagcugaagcaggagauccgggacguggugaucuucuaccagcgcaagcucaagucucagaagcaccucaucuccgacugccuguucgagaagcaccacaaggccauccccaaaagcuccccgcuguuccaggaguucaagaucuggcagaaccucaacuaccuggaguucguccacacccagagcaaggagaagaucuucuucuccgagcuggacgacgagacccgccaguucguguucgccgagcucaacauccggggcacccugaagauaaaggagaucaagaaacugaucggccucgagacccccguguacuggaaguccaacuuugacgagaucgaagggaaccgcaccaaccagguccuguacaacguguaccagaacaucgccgacgaccugggcuauggguucgacuggagcaagaagcacgccuucgagauaaacgcggagcugcaggccaucuucaaggacgugggcaucgacacggccauacucaacuucgacgccagcaucgaggagaacgacuucgacaaacagaaauccuaccagcuguggcaccuccuguacagcgccgaggacaccgacaaggcgaccgaggaggacaagcugaucuacgggaacaucaacaccaagcugaagaagcagcuccaccagaaguacggcuucgaggccaaguacggcaaccugcuggccaacaucucccuacagcaggacuacgggaaccugagcgccaaggccaucaagaagauccugcccuaccucgaguccggcaacaguuucuacgaggcgugcacgaucgucggguacaaccccuccaacagccugaccaaggagcagcagcagaaccggaagcucaaggacaagcucgagcugcugccaaagaacucccuccgcaaccccguggucgaaaagauccugaaccagaaggugaaccugaucaaccagcuaaucgacgaguacggcaagccugacgaggugcggaucgagcuggcccgcgagcugaagaaguccgccaagcagcgggccgaccucagcaagcacaucaacgacgcgacccugaagaaccagaacauccgcaagacccugcagaaggacuucgggauccagaaccccagcaagaacgacgucauccgauacaagcucuacgacgagcugaaggacaacggcuacaagacucuguucaccaacaaguacaucccgaaggagcagcuguucucuaaggacguggacaucgagcacaucauccccaaggccauccuguucgacgacuccuucagcaacaagacccuggccuaccgcaacgugaaccucgccaaggccgacgcgaccgccuucgacuucaucuccagcaagcacuuagacgaccuggacaacuacaaggcccgggucgagacccucuuccaguccaagcgcaucagcaagggcaaauacaagaagcugcugaugacccggcagaaccucccugaggacuuuaucgagcgggaccugcggaacucccaguacaucgccaagaaggccaccgcgaugcugaaggagguguuccgcagcgugguccccaccuccgggcggaucacggacaagcuccgugaggacugggaccuggugaacgugaugaaggagcugaaccucccgaaguaccggacccugggccugaccgaguucaucgagcgcaagaacgggaacaagaucgagcaaaucaucgacuggaccaagcgcaacgaccaccggcaccacgccauggacgcgcucaccgucgccuucacgacccacaaccacauccaguaccugaacaaccugaacgugacgcacggucucaacgggguggacaccgaucacgagaagucccgccuguaugccaucaagcaggcgaucacaaaggucuacaucgugggcaagaccaagaaacggaaguucaucccgcccauggagaacuuccgcagccacgccaagaaccaccuggagggcauccucaucagcuucaaaaauaagaacaagguggucacuaagaacaagaaccggaccaagacgaagaccaaggggguguucaacgagaagauccagcugacgccccgcggccaacugcacaaggagaccaucuacggucacgccaagaaagugaucgucaccaaggagaagguguccagcaaguucacccacgagaagauccuucaggugaccaaacccgccuaccgggaggcgcugcugaagcgccucgccuccuucaagaacgaccccaagaaggccuucagcggcaagaacgcccugagcaagaacccccuguacuuugacaucaccuccggcaagaagguccccgacacggugaagcucagcuacuucgagaacuccuacgugauccggaaggaggucaacagcgacaacuucaagaacgagaagucccugcagaaggugcuggacguggggauccgucggauccuagagaagcgccuggccgacuacaacggcaaugcgaaggaggccuucagcaaccuggagaagaacccgaucuggaaggacaaggagaagggggucugcaucaagaaggugcggaucgaggcccucaagaacgccgagccccugcacgugaagaaggaccaccugggcaagaucauccucgacgacgagaacaaguccacccccgucgacuucaucagcaccgggaacaaccaccacguggccaucuacgaggacaaggacggcaagcugcaugacaagguggucuccuucuacgagguggugagccgcgucaaccugggccuacccauuaucgacaaguccuucaacagccaccuggauuggaaauuccuguucuccaugaagcagaacgagauguucguguucccgagcgaggacuucaaccccaaggaaaucgacaucgggaaccccaaaaacaacgagcucaucuccaaguaccuguuccgggugcagaaguucagcaaggucaccuacggcaacuccgcggugcgcgacuacguauuccgucaccaucuggagacggagcucaucgacaagaaagagcugaaggggaucaccuacuaccagcucaagagcaucggcaugcuggaaaagcuggucaaggugcgcaucaaccacaucgggaagaucgugcacaucggcgaguacuga

SEQ ID NO: 7882 - RNA, 4176 nt, Artificial Sequence
  Cas9 variant
augaagaccauccugggacucgaccuggggaccaacagcaucgguugggcccuggugaaggaggccgagaacgagaacgaggucuccgacaucaucaagcucggggugcgcgugaacccccugacggucgaugaguuaaccaacuucgagggcgggaaggcguacagcaacaacgccgagcggacccucaagcgcggcgcccggcgcaaccugcagcgguacaagcugcgccgggagaaccucaucgagauccugcugaagaacggccucaucaacaaggacaccgcccugacggagguggggaaggagaccacucaccagacccugaagcuccgcuccaagagcgccaacgagaaggugucccuggaggaccuggccaagauccuccugagcaucaacaagaagcggggcuacaaguccagccgcaaggucaaugccgaggacgacgggguagccaucgacggcauggagguggccaagcugcucuacgacgaaaacaugacgccgggggaguacguccugcggcugcucgaguccggcaagaaacaccuccccgacuucuaccgcagcgaccugcaggaggaguucaaccucguguggaagaagcaguccgaguucuacccccugaucuuaaccaaggagcuguucuucgagcugcacggcaagaacaagagccagaccugggcgaucugcaaggagccccuggggaucgugggcgucaaacucaagggguccgccaaggagcagaaguuugcccgguaccgccugcggaaggaggccuuaacccagcagaucgagcucgagcaccuggccaucgugcugcaggacaucaacaacgacagcaacaaguccagcggcuaccucggcgcgaucuccgaccgcagcaaggagcuguucuucaacaaggagacgguggggcaguaccaguacaagcagcugcagaaggacccgaacaccucccucaaaaaccaggucuucuaccggcaggacuaccuggacgaguucgaaguuaucuggcgcaaccaggccaaauucuacccccagcugaccaacgagcucaagcaggagauccgggacguggucaucuucuaccagcgcaagcugaagucccagaaaaaccugaucuccuucugccaguucgaguccacccagcagaacuacguggagaaggagacgggaaagaccaagauccggaccaucgggcgccgcgugauccccagaagcucucccuuguuccaggaguucaagauauggcagagccugaacaaccugaaguucgucaacuccgagagcaaccagaucauccaguucaucgagcuugaggacgacgugaagaagguggucuucgacgagcucaaccugcgcggcgacuuaaagccgaaccaggugcucaagauccuguccaaguacaugaagaucgggaagcugacccaauggaagugcaaccucgaggagaucgagggcaaucggacgaacagcgcccucuacaacgucuuccagaugaucgccgaggaggagggcuauggguucaacuggggcaagaaguccgcccuggagaucaagagcgagcucaaggcgaucuucuccagcaucgggaucaacgacuccauccuggacuucgacuucagcaagaaacuugaccagcagcucuccuaucagcuauggcaccuccuguacagcgccgaggagggcaacuccaaaaucaccgaggaggacaaguucaccuacgggaacaccgguguggcccugaagaagaagcugcaccucaaguucggcuucaagcccgaguacagcacgcugaucuccaaccugcgcuucaccagcgacuacgggaaccucagcuccaaggccaucagcaagauccugcccuuccugcgggacggcuccgacuacagcaaggccugccaguacgccggguacaaccacuccaacagccucuccgccgacgagcuggacaaccgcgagcugaagcccaagcucgagcugcugaagaagaacagcuugcggaacccgguggucgagaagauccugaaccagauggugaacguggucaaccaggugaucgacaauuacggcaagcccgacgaggugcgcauagagcucgcccgggagcucaagaaguccgccaaagagcgcagccagaugaccaagaauaucagcgacgccaccaggcgcaacgcggagaucaagaaguaccugagcaaggaguucgggauccccaaccccacgaagggcgacgucauccgauaccgccugugggaggagcuagcuuccaacggcuauaaggaccuguuccgcgacaaguacaucccgaaggagaagcuguucagcaacgagaucgacaucgagcacaucauccccaaggcccuccuguucgacgacuccuucucuaacaagacccuggcuuuuaagguggacaaccucaagaaggcugaccgcacagccuucgacuucauguccacugacuucagcaaggacguggacagcuacaucgggcggaucgagacgcugcacaaggacggcaagaucuccagcuccaaguacaagaagcugaugauccccaagagcaagcucgucgacggguucaucgagcgcgaccugcggaacacccaguacaucgccaagcaggccaggaagaugcugcucgagguguucaagaccgugguccccaccacggggaagaucaccgacaaguuacgcgaggacugggaccugaucaacgugaugaaggagcuuaacuucccaaaguacaaggcccugggccugaccaaaaagaucgagcgguucgacgugggguccgagaagaucaagagcaucaacgucaucgagggcugguccaagcgcaacgaccaccgucaccacgcgauggacgcccucgccguggccuucaccacccacaaucacauccaguaccugaacuaccugaacgcucgcaaggacauccaccacgagaugcacgggacgauuaagagcaucgagaaccagaucaucggcaaggacgucauggggaaacggcgcuucaucccgcccaucuccgaccuccggaugaaggcgaaacugcaaaucgagagcauccuaaucuccuucaagaacaagaacaaggucgugaccuggagcgugaacaagaccaagcucaagggcaaggauaacuacaacaagcgccggcagcugacgccccgcggccagcugcacaaggagaccguuuacgggaagaucaagcucaucgaccccaagccccugaagcugaacaacaaguucacccucgugcgggcguccaugaucguggacaagguccaccgcgagaucgugcugcagcaccugagcaaguacgacaacaacuccgagguggccuucgacagcaagaccaucaagaucgaccccauccucaucgagggcaucgggcugaaggaggucgugugcuacgaggacguguucaagauccggaagaagaucuccggcgacaacuucaagaacgagaaacaccuggagaaagucaucgacgagaaggugaagcagauccucaaggaccgcgugaucaaguuccaggggaacuucaaggaggccuucagcaaccuggaggagaacccgaucuggcugaacaaguccaagggcaucgccgucaagagcguggcgauuaagggcgugaacaacgccgagagccuccacgaggggaaagaccacuucggcgaccagauccuggacaagaacaagaagcagaucccgguggacuucguguccaccgggaacaaccaccacgugggcaucuacgaggacaaggacgggaaccugcaggagcgggucgugagcuucuucgaggccgugacgcgcguuaacgagggccuccccaucauagacaagaccuacaacuccgacaucggcuggaaguucaaguucaccaugaagcagaacgagauguucguguuccccagcgacgacuuugacccgaacgaguucgaccugaccgaugggaagaacgccgcgaagaucucccccaaucuguaccgggugcagaagaucgccacgaagaacuacauguuccgccaccaccucgagaccgucgugaccaacgaccuggaguucaccuacaaaucaauccgguccacgggcuggcugcgcaacuuagugaaaguccggaucaaccaccugggggagaucguguacgucggcgaguacuga

SEQ ID NO: 7883 - RNA, 4176 nt, Artificial Sequence
  Cas9 variant
augaagaagauccugggacucgaccuggggaccaccagcaucggcugggcccuggugaacgagaaggagaacaacgaggagcuauccagcaucauccgccuggggguccgggugaacccccugaccguggacgagaagucuaacuucgagaagggcaaggacaucaccaccaacgccgaccgcaccaagugccgcagcgcgcgucggaaccuccagcgcuucaagcugcggcgcgaggcccuggccgacugccucaagcggcacgggcugaugacggacgagaccccgcugugcgagaccaacaacuccaucaucuucaagaccuacagcaaccgcgccaaggccgucugcgagaagaucgcgcucgacgacuucgugcgggugcuguucaugauaaacaagaaacgcggcuacaaauccagccggaagcugaacacggacgacgagggcacccucgucgacgggauggacguggccaagcugcuguacaacgagcagaucaccccaggcgaauaccuccugcgccuguucaagaaggggaagaagacccggcccgacuucuaucucuccgaccugaaggccgagcuggagcgcaucugggacuuccagcggacguucuaccccgagauccucugcaacgcccugaaggaggaccugaagggcaagagccgcacacaauccagcgcgaucuucuacgcaaaguacaaaguguccaccgccaagaucgccgggaaggacaagcggcuccaggagcugaccuggcgcacggacgcccugcggaaacagcucaccauagacgaggucgcguacgugaucugcagcaucaacggcgaggugaacggcuccagccagcgccuguccaugaucagcgaccgcuccaagcugcucuacuucaaccaccagaccauagggcaguaccugaugcagcggcuggaggagaacccgaacgccggccucaagaacaucaucuucuaccgccaggacuacgaggacgaguucaacgacauuuggaacagccaggccaccuaccacaaggagcugacgcccgagcugaagaaggaggucaaggacaucaucuucuaccagcgggggcucaagagcugcaaguggcugaucaacuacugcgagcuggagcaugaggagaucgaggugaagacccccgagggcaagcuccgcaagaucaccaucggcuccaagaccugcccaaaaagcuccccgcuguuccaagaguucaagaucuggcagguccugaacaaccuccaggugagcccccugaacucccggcgcaaggccaagcggaagaaggacgaggagcccagccuguuuuccgacgaggacaugaacacggccugccgcuaccucaacgaggaggagaagcugacccuguucaaggagcugagcaucaagaaggagcucaagaagaaggacgcgcugaagcuccuguucgagaauuacaaggagcuggaccugaacuacaaagugaucuccgggaacgugaccauggccaaucucuacagggccuuccaggacaucaucagccugaccggcaacggggaguucgacuuccaggcaaugcccgccgaggaggcagagaagacggucgaggagauuuucggcgggcugggcuacaagacagccuuccuccacuucgacgccucccugcacgacaaggaguucgagcgccagccggccuaccggcuguggcaccuccuguacagcuaugccggcgaccaguccaagaccgggaucgaggcucuggugaagcgcauccaggagcucugcggcuucgagcccgaguacgcccggauccuggccaauaucagcuucauccccgacuacggcaaucuguccagcaaagccaugcgcaagauccuccccuacaugcaggacggcuacgaauacuccgaggcgugcagcaaggccggguaccggcacuccgccagcagccugaccaaggaggagaucaacaagaagaacuacaagacgcaccuggacgagaucaagcgcaacucccuccggaacccgaucguggaaaagauccugaaccagauggucaacguggugaacagcgucaucgacaccuacuccaacaucgacgagaucagaaucgagauggcccgggagcugaagaaguccaagcccgagcgcgaggacaugagcuucgccaucagcaaggcgaccaaggagaccgagcgcaucaagggcauccucgagcaggaguucaagauccagcacgugacgcggaacgacaucauccgcuaccggcuguacgaggagcugaagcccaauggcuacaagacccucuauuccaacaccuacaucccccgcgaggacuuguucagcaagaaguucgacaucgagcacaucaucccgaaggcccgccuguucgacgacuccuacagcaacaagacccucgagcugcgcgauaucaacaucgagaagggcaaccagaccgccuacgacuucguccuguccaaguacggcgaggaggggcucuacaaguacgagcagcggguggaggaguucaagaagaauaacgagcaggcaggcacgaagugccgcaagcugcugaugcgggaggccgacauccccagcgacuuccucaaccgcgaccugaacgacucccaguacaucgcgaagaaggcccacgaguugcuccgggagaucgugcccaccgucaccgccaccacggggagcaucaccaaccgccugcgggaagacuggaagcuggugaacgugaugaaggagcucaauugggagaaguacgacaagcugggcuugaccgaggaguacaaggauaaggacggcaacaccguccgccacaucaaggacuggacgaagcggaacgaccaccgccaccacgccauggacgcccucaccaucgcguucaccaagcccuccuucauccaguaccugaacaaccugaacgcccggagcaaccgcgggggcuccaucuacgggaucgagcagaaggagcucgagcgggagaacaauaagcugguguucaucccgcccaucgaccccaagaucuuccgcaagcaggccaaggagcaccugagcaacauccucaucagcaucaaggccaagaacaagguggucaccaagaacgugaacaagacgaaguccaagagcggcaccaaccggaaggugcagcugacgccccgcggccagcugcaccucgagaccgucuacgggaagauccgcaccuacaagaccgaggagaucaaggugggcaccaagcugaccgaggagcugaucgcgaagguggccgacaagaagauccgggaggcucucaugcagcgccuguccgaguacgggggcaacaucaagaaggcguuccagaacaucagcaagcacccgaucuggcugaacgggucccacacgaagcacguccccgagaaggugaagaucguguucuucgaggacguuuucaccauccggaaggccaucaccccagacaucaagaucgacaaggugaucgacagcaagauccgccggauccuccaggagcgccugaacgaguucgggggcgaggcguccaaggccuucagcaaucuggacgagaacccgaucugguucaaccgggacaaggggaucgccaucaaauccgugaagauccgcggcaucgccaaggggaccgccauccgggucaagaaggacauccacggcaagacgaucaucgggaacaacggauaccccguggcgaaugacuacgugaacaccggcaacaaccaccacgucgccaucuuccgcgacaaggaugggaaccuccaggagcacaucgugagcuucuacgaggccaccgcgcgggccauccagaaccuucccaucguggaccgcaacuacaacuccgagaaggacuggaaguuccuguucagcaugaagcagaacgaguacuucgucuuccccaacccgaacaccggcuucaaccccuccgagaucagccucaaggacgagaagaacuacgcgcugaucucccccaaccuguuccgggugcagaaguuaagccacuacuacuacguguuccgccaccaccuggagacuaacguugacacaaaccugcagcucaaggacauuaccuggaagcggaucaccgccgugaacaaccugacaggggccgugaagguccgcaucgaccaccugggccggaucguggacgugggggaguacaaguga

SEQ ID NO: 7884 - RNA, 4176 nt, Artificial Sequence
  Cas9 variant
augaagaacuaccacaucggccuggacaucgggaccagcuccgugggcuucgccgcccgcgacgacgacaacaaccucaucagagucaaggggaagaacgugaucggcgcgcggcuguucagcgagggucagaccgcccaggagcggcgcauggcccggaccucccgccggcgcuacaaucggcgcaaguggcggcugcgccuccuggacgagaucuuccaugacgaaaucauccacaaggacgccgaguucuucaaccggcugaagcagagcuuccucucccccaaggacgagcgcaagcaguacuucggcagccugcuguucccggagaccggcgacuccgaguauuaccacaacggaaaccagaccaucuaccaccuccgccaccgccugaucacccaggacgagaaggcagacauccgggagauauaccuggcgcuccgccacaucaucaaguaccggggcaauuuccuggacgacacgcccgugagcuccuucgaggccagcgaccuaaagcucgccuccuucguccccaccaucaacgaucuguucgagaccaucgacgugaacuacgaguucagcauggacaacaucaacgagaucgaggacauccugcucaacaacaagcugcgcaauuccgacaagagcaagcaguuaaccgaccucuugacugagcccaucgugaacaucgacgacaagucccuggagaagcaguucaacaaggagcggaccgacaucagcaaggagaucgccaagucugucguggggagcaagaugaacgugaacaagcuccuguccuucgagagcagcgagggcuccaagaucgcguucagcuucuccgacgccagcuccgaggacaagaugauggagcugagcgacauccuagacgacucccgcaugaacauccugaacauccuaaagguaaucuacagccgcgugcggcucaaccagaucaucccguccgggaugggucugagcgaguccaugguggccgcauacgacagccacaagcagcagcugaaggaccucaagacccugcugaacguucuccccuucaacgagcgcuacgccgugaagaucgcguacgccgccuacaucggcaacaucgauaagcagaaguucaccaaguccgagaucaaggccaucgacaagcugaaggagaaguccgccaucaugaacgugcuggacuucaaguccgggcacaucacgaacgaggagcucagcaacgucaucaaggccgugaucguggacaaguaccugaacgacgaggacuucgaguaccacggcaucgucgagaagaucaaccaggacaucuccaaugggagcuaccugcuuaagcagcggaacaaccaaaacgguaacauuccccaccagcugcaccagauggagcuggaccagauuaucgagaaccaguccaaguacuaccacuuccucggcgaguuaaaccccaacagcaaccgcaaccacaucgccaaguacaagaucagcgagcugguggccuuccgggugccguacuacguuggaccccucaucacccccgaggagcaggagaagaccuccggcgccagcuucgccuggaugaagagaaagaaggacggggcgaucacccccuggaacuucgaggagaagguggacaaggaagagacggccucccgguucaucaagcgccugaccgugaaggacaccuaccugcugaaugaggacguccucccggacaacagccugcuguacgagaaguuuaaggugcucaacgagcugaacgucgugaaggccaacaacaagcgccuuaccgucgaggagaagcagggcgccuucgacaaccucuucaagaagaugaagacggucaccgccaagcgccugaagaacuaccugguguccaaccacaaccacaucaacagcguggaaaucaccgggcucuccgacggcgacaaauucaacaacagccuguccaccuacaucgacuucaagaagaucuuuggcgacaaaaucgacaaccccgggcugcucgacgacuucgaggacaucaucgaguggagcacgguauucgaggaccggaagaucuucgaggagaaggugcgcaaggacaucuccuggaucagcgaguccgagaucaagagcguggucuccaaacgguacagcggcugggggcgccuguccaaaaagcugcucaacugcaucaccaacaacgagggccggaacaucaucgacgagcugugggaggagagcgagaccuucauggaggcggugagcaagcccgaggucaaggagcagaucgacgggaucaacuccgacuucaucaagaacacagacaucgagagcgugcuggccgaugccuacaccagcccccagaacaagaaggccauucgcgagacccacaagcucgugaaggacauccagaaggcgaugggcggccaggccccggccagcaucuccaucgaguuuacccggaacccccaagacaaggggcagcugacccgcagccggcacuccgaggugagccgcaaguacaaggaaaucuccaaggagaucagcaagacgcugaaugacgagcucaaguccaagaagaacucgauggacgucgacaaguacuaccuguacuucaugcagaugggcaucgaccuguacgacggguccagcaucgacaucgacgaccucaacaacuaccagaucgaccauaucaucccccagaguuucuacaaggacgacagcuucgacaaccgcgugcugacccauuacuccaacaaccagaagaagggcaacaacacgccccugaacggacucaacaucaacgacaagacccgggccaucuggaaccaccuccgcgaccugggccuuaucaccaagaagaaguacaacggccugacccugaaagggauggaccagcucagcaaguacaccaagcacggcuucauccggcgccagcugguggagaccucccaggucaucaagcugguggccaacauccucagcgaugaguucagcacggacgacacgaaaaucaucgaggugaaggcgaagaugaacucccagaucagacaggucuucaaccuguacaaggugcgcgaacugaacgacuaccaccacgccguggacgccuaccucaccaccuucaucgggggcuaccuguauaaccgguacccgaaccugcggaacauguucgucuacggcgacuuuaagaaguucagcgccgacguggacaaccucaagaccuucaacuuccugcacgagaucacgaaccccuccgacaaguucgaggaccggaucuucgacgagaaguccggggagcugauacucgaccgcaagcacgccaucgaaaccaucaagaagaucuaccaguacaaguacaugcugaucacccgggaggugagcaccaagaacggccagcugagcgaccagacagucuacuccgcgaagcgcaucaacaacgugaaggcccccaucccagugaagaaggacuucaacccggagcucuacggguuucggaccggcaacgucgaccaccacaugguaauagugaaguaccccaagaaggacagcuacgacuacaaggucguggguaucccccugcgcuucgugcagaaguugaaggagaccaaggacaacaaggacuacgagaaccuccugaaccaaaucguccagaugaagcugaaccggaagaaacaggacuucaucgugguggucgacaacgugauguacggccaguugauccaggacggcgggcagaaguucacccugggcuccucaacguaccguuacaacgccaagcagcuggugaucgacaacggguaccucaagcugaucgccgacgagcgguacaagaacucccugaccgacgaggagaaguccaaccaguacaucacccucuauaacgagauccugaaggucgugaacggccgcuucgacguguucgacgucaacagcuuccggaagaagcugaacaacgggguggacaaguucaucaagcucaacaccguggacaagcgcaucaucaucaugaagauccugucgggucugcacugcggccccuccaucgucccgcucaaggagcuggggcugacgacgccccucggccagcugcagagcaccagugggaucagccuguccgagaacaccaucaucaucuaccaaagccccagcggccucuucgagcggaaggugcgccugggggaccuauga

SEQ ID NO: 7885 - RNA, 4176 nt, Artificial Sequence
  Cas9 variant
augaagaacuaccacaucggccuggacaucgggaccagcuccgugggcuucgccgcccgcgacgacgacaacaaccucauccgggucaaggggaagaacguaaucggcgcgcgccuuuuuagcgaggggaagaccgcccaggagcggcgcaucucccggaccagccgccggcgcuacaaccggcgcaaguggcggcugcgccuccuggacgagaucuuccacgaugccaucgugcacaaggacgccgaguucuucaacagacugaagcaguccagccucucccccaaggacgagcgcaagcaguacuucggcagccugcuguucccggaggucggcgacggggacuacuuccgggacggcaaccagaccaucuaccaccuccgccaccggcugaugacccaggacgagaaggccgacauccgcgaaguguaccuggcgcuccggcacaucaucaaguaccgcgggaacuuccuggacgacacccccguguccagcuucgaggccuccgaccugaagcucgccagcuucguccccacgcugaacgaccuguucgagaccaucaacgugaacuacgagcucagcaucgacaacgugaaccaaaucgagaacauccugcugaauaacaagcuccggaacagcgacaaguccaaacagcugaccgaccugaucgccgagcccgucaccaacaucgacgacaagagccucaagaagcaguucgacaaggagcgcaaggacaucuccaaggagaucgcgaaggccguggugggcagcaaaaugaacgucaacaagcugcuguccuucgagagcagcgacggguccaagauaaguuucuccuucagcgacgccuccagugaggacaagaugcucgagcuguccgacauccuggacgacagccgcaugaacauccucaacgugcugaagguaaucuacucccggguccgccugaaccagaucaucccgagcggcaugggucucuccgagagcaugaucgccgccuacgaccugcacaagcagcagcugaaggaccucaagacguugcuggacguggugccguucaacgagaaguacgcggucaagaucgcuuacgccgccuacaucggcaacaucgacaagcagcgguucaccaaggccgaggugaagaccaucgacaagcuccgcgacaagaaguccaucaccagcgugcuggacuucaaguccggccacaucacgaacgaggagcugaacaacgucaucaaggaggugaucguggacaaguaccucaacgacgagaccuucgaguaccacgacaucgucgagaagaucaaccaagacaucagcaacgggaacuaccugcugaagcagcggaacaaccagaacggcaacaucccccaccagcuccaccagauggagcuggaccagaucaucgagaagcaguccaaguauuaccccuuccugggcaaacucaacccgaacagcaagcgcucccacaucgcgaaguacaagaucagcgagcugguggccuuccggguccccuacuacguggggccccugaucacccccgaggagcaggagaagacuucgggcgccuccuucgccuggaugaagcgcaaggaagacggggccaucacgccguggaacuucgagaagaugguggacaaggagagcaccgcgucccgguucaucaagcggcugaccgucaaggacaccuaccuccugaacgaggacgugcuccccgacaacagccuccuguacgagaaguucaaggugcugaacgagcucaacgucgugaaggccaacaacaagcggcugacgguggaggagaaacagggcgccuucgacaaccuguucaagcagaugaagaccgucaccgccaagcgccucaagaacuaccugguguccaaccacaaucacaucaacucugugaagaucaccgggcuguccgacggcgaaaaguucaacaacagccucuccgucuacaucgacuucaagaagaucuucggcgacaagauugacgacagcaagcuguucgaugacuucgagaacaucaucgagugguccacgguguucgaggaccgggacaucuucgaggagaaggugcgcaaggauaucagcuggaucuccgagagcgagaucaacgcagucguguccaagcgguacagcggguggggccgccuguccaagaagcuccuaaacgggaucaccaacgacgagggccggaacaucauugaugagcugugggaggagagcgagaccuucauggaggcggugagcaagcccgaggucaaggagaaaaucgacgagaucaacuccaacuucaucaagaacaccgacaucgagagcgugcucgccgacgccuacacgagcccccagaacaaaaaggccauccgcgagaccuacaagcuggugaaggacauccagaaggcgaugggcggucaggccccgagcuccaucagcaucgaguucacccggaacccccaggacaagggcgagcugacccgcucccgccacagcgagaucgccaagaaguauaaggagcucucgaaggaggucagcaagaagcugaacgacgagcugaaguccaagaagaacagcauggacguggauaaguacuaccuauacuucaugcagauggggauugaccuguacgacggcacguccaucgacaucgacgaccugaacaacuaccagaucgaccacaucgugccccagagcuucuacaaggacgacuccuucgacaaccggguccucacccacuacagcaacaaccagaagaagggaaauaacacgcccuuaaacggccugaauaucgacuccaacacacgcgagguguggaaccaccucaucgggcugggccugaucaccaagcggaaguacaacaaccucacccugaagggcauggaccagcugucuaaguacaccaagcacggguucauccgccggcagcucguggagaccucccaggucaucaagcugguggccaacauccugagcgacgaguacucaaaggaugacaccaagaucaucgaggugaaggccaagcucaacucccagauccgccaggucuucaaccuguacaagauccgggagcugaacgacuaccaccacgcgcucgacgccuaccugacgaccuucaucggaggguaucuguacaaccgcuacccgaaccuccggaacauguucguguacggcgacuucaagaaauucagcgccaagaucgacaaccuggagaccuucaacuuucuucacgacaucaccaaccccuccgacaaguucgaggaccgcauaaucgacgagaaguccggcgaggugauccucgaccgccgccacgccaucgagacgaucaagaaaaucuaccaguacaacuacaugcugaucacccgggaggucuccaccaaaaacgggcagcugagcgaccagaccguguacuccgcccgccggaucaacaaggugaacagccccauccccgucaagaaggacuccaacccggagcucuacggcuuucgcacugggaacguggaccaccacauggugaucgucaaguaccugaacaaggacaaauacgacuacaaaaucaucggcaucccacuccgguucguccaggugcucaagaacagcaacgacaacaccgaguacaagaacaucuugaacaaaaucgugcaguccaagcuaaagggcaagagcaccgacuuccgcgugauccucgacaacgugauguaugggcagcugauccaggacggcgggcagaaguucacccugggcuccagcacguacaaguacaacgcgaagcagcucgucaucaacauggacgacauccggauccugguggacaaccgcuauuucaacucccugagcgacgacgacgccuccggggaguucaucaagaucuacaacgagauccucaaggugaucaacgcccgguucgaccuguucgacaucaacaaguuccgcgagaagcugaacaacggcaaggaguacuucgagaaccucagcaucgacgagaagaaccagguucugcugaagaugcucuccgggcugcacugcggcagcgccaacguacccaucaaggagcugggccucaccacgccccuggggaagcugcagaucccgagcggcaucgugcucuccgaggacgccauugucaucuaccagagccccuccggucuguucgagcgcaagauccggcugaaggacaucuga

SEQ ID NO: 7886 - RNA, 4176 nt, Artificial Sequence
  Cas9 variant
augaaucugcgcaauuauccgggugaauacagcauaggccucgacaugggaacaggcagcgucggauggagcgugguggacgaaaagggaaaccuacuccacuucaagaagaaaccgacguggggcagcaggcuauucgacagcgugaugccagcaagugaagccagaguucaccgcggucaaagacgccgguacgaacgccgccgcuggcgacuagaccuccuacaggggcuauuuaaaaacgaaaugaacaaaguagaccccgaguucuucaugcgccuaaaucaaagccggaccaucgaaggugauccgaucuuuacaaaaucauucacaaaagccgacuacuacgauagguucccgacaauuuaccaucugcgcgcauaccugauggaaucaaacgagccagcagaccuacggcucauauaccucgcaaugcacaacauaaucaagcaccgaggcaacuuccuucgagaagaagaaaaaucacugucggcuaagcacgcagacucgaaaaaggccgugacgcaauucgucgacgcccuaaaagaauggugcuucucgcgcggcuacgaguucggcaaggacccagcuaaaagcauagaaaaguguuuaucagacaguaaaagcuccagaucgcaauuagcauccgaaaucgcgaaagcacuggcaguaucgaccgacgcugcagccgcagauaagaagcucgcagacaaccucgccaaggcgaugguaggccuucaaugcgaguucaaauacguauuuggcgaguucgacugcgaaaguacuaagcucgcacucagcgaugacgaaaaguuagaauuacuaagagcagcaugcccagacgacagcgucgaauuacucgacgccuuaugcgcaguauacucggccuacgugcugcaaggcuugcucuccuacgcgcccggccagaccauaagccauaacaugauagcaaaauacgaccuuuacaaaacagaccucaaaacgcucagagcgcuaguccgcgaauaugcccccggcgcguacgaugaguucuuccggggcgcgaccuaccacgacgcgaacccggaugacucaagcaaagacuacagcuacgcggacgccgaaggguacacggcauacaaucuccacaaacuguccuacgacgacuucgcaaaagccguaaagaaacuacuaggcggaacggaugcagucacagacgaaagguaccugaacaugauggaacgcuuugaaaaacaacaguuuuuaagacgacugaaaacguccgacaacggagccauuuacuaccaacuccaccucgaagaacuaaccgcuauaauaaagaaccaaggcagauucuacucauuccuaaaagaguacgaaggaaaauucgaauccuuaguuuccuuccgcaucccauacuacguagggccguuaaccuccguuaacgcagcccaagacucacacaaucacaaccgauuccaauggucggaacguaagccaggaauggagcgcgaaguaauaacccccuggaacugggacacuauaaucgacaaaaacaaaucagcugaaaacuucauaaugcggaugacaggggacuguacuuaccucgccggugaaaaggugcuacccaagcagucccuccuguacgaggaguucugcguacucaacgaacuaaacggaguacggugguccgacgauggagacgauuggcaacgguucgaugcagcacaacgcgagggcaucguucgagaacuauuccauaaauacagaagaguuaccuacaagaugcucgaagacugguuagugagggaaggagacgccaaccaccccauagugaaaggugggcagggcgagacaggucuagagucaaaaaugggaagcuacuuauucuucgcaaaaggaauuuuugggcucggcgagcuaagccccgccgaauacccagcaaucgagaaaaugauaaaauggaacacccucuucgaagacagaaguauccucaaagaaaaacuagaagacgaguucggagagcgcggaaacggcaugcuagacgccucccaaaucaaagcuauaugcaagaaaagauuuacgggauggggaaggcucuccgaacaguuucucaccggccugaaaguggaaagcccugccggacgcgccgucagcaucauggacguacucagagagggaaaccccugcagcgaaaggcgccagggugagacaguagugaugauggaagcacugagggacgaaggacuaggguuccagaagaaaauagacgagcacaaccguaacuacuaugggcaacacggcaaagaccuaggaguuaacgagcugccaggcucccccgccauccggcgaagccuuaaccaggccauacggauuguagaggagauagcgagcauagccggccacgcacccgccaacauauuuaucgaagugacccgcggagaagacgcgggcaagaaaggcaaaaggaccgugaaaaggugggacaaaauaggagaggcccugaagaaacuuaaagaagaaggcgucgcugucgaagugauggacgacuucaaagaacaaaaagccaucaacgcaaaccuggaugaaagguuaucacuauaccucaugcagaacgggaagugccuauauucgggcaaggcaaucaaccuagagaaauuacuugccggcucgggggaguaugagguagaccacauaauaccccgagcauacauaaaggaugacucgaucgaaaacaaggcgcugguacucagagaggaaaaccaacacaagacugaccaacuacugaucgacaaaagcauacgcuggaagaugcgagagacuuggagccaacuacacgacgcuggccuaauuggggacaaaaaguaccacaaucuccugagaagcaacauaaacgaaaaccaacugcgcggauucaucgcgcgccagcuuguagaaacaucccagaugguaaagcuggcgcaagcccugcucgaagcacgcuucgccaacgaagagacccgaaucguuccggucaaagcaagcaugagccauaaucugcgagaggcagccgacuuagccaaaugccgagaggcaaacgauuuccaccacgcgcacgacgccuucuuagccagcagaauaggccucuucguacaaaugaggcaccccgggaucuacgaaaacccaauaggauacagucacgugauaaagaaauacguccaagaacagagcgaaguguucaagaagacgcacaggaugccgggaucagcaggauucguaauaaacagcuucaugagcagcggcuucgacaaggacacgggcgaaguauucaaagacagcugggaugccgaagcugaagucgauggaaucagaaaagcacucaacuacaggcaaugcuacauaagcaggaugccacaacaagacacaggggcauuuuggaaugcaaccguguacagcccucgggacccaaagaugggaccuaaacuagcgcugucaacaaagcaaggccuagacccaaaguuauacggaggcuucucaucccagcaauucgcauacuuuuucaucuacgaggccaaaaagaaagggaaacccacguuccgcuucagccaggucccugucuggcuggcggcucggaucgaagccaacccccuggcccuagaggaguacgcgcgagggcuagcaaaaggcgagggacucgaguucgucagcauacaacgaccaaaaauauacaagaaacagcuaauagaaguaaauggcgacaaacucauaaucaccggggcaaaagaaguccgaagcggcgcagaacuagcauucaaccaagacgaaauaucagcgaucucaaugugcagcaaacuccgcgccgccgaagcaggacuugacggcgccuucucagaggaagucucagcuaucuggaaccgaaucagcaaugcaccaguacaaagcuguggccgacuacuccggcaacugacacucccgaaguaccaaucaaacuucgauagcagcuccaacgaggagaaggcagcaguaguucuaggcuuaaucgcccuucucaacggaaacaaccgaaucguugauuuaagcggggugggcgggagcagccaugcaggggcaaugaugaugucauaccccaaacugcucgaugauccgaaaguacccuuuuucauaaucgaccaaucgguuacgggaauguucgagcgaaaaacaaggguuggccuauga

SEQ ID NO: 7887 - RNA, 4176 nt, Artificial Sequence; identical to SEQ ID NO: 2087
  Cas9 variant

SEQ ID NO: 7888 - RNA, 4176 nt, Artificial Sequence
  Cas9 variant
augaagaaacgcauugacgacuauauccugggccucgacaucgggaccaacagcugcggcugggcagugaccgacaagaagaauaaccugcuuaagcuccggggcaagacggccaucggcagucaccuguucgaagaggggcacaccgcggccgaccgccggggauuuaggacgacucggcgccggcugaagcgucgcaaguggcgccuccggcugcuggaagagaucuucgccgagcccauggccgaggucgacccaggcuucuuugugcgccuccaucagagcugggugucuccccuggacaagucucggaagaaauaccaggccaucgucuucccgacggcgaaggaggaccaggaauauuaccagaaguaccccaccaucuaccaccuccgcgacgcccugaugacccaagaccggcaguuugaccugcgcgagaucuuccuggccauccaccacaucgugaaguaccgggggaacuucuugcaagacaccgccgugaaggacuucgaggcgucgaagaucgaggucggcccgauccugacgaacaucaacaaugcuuucgccgacaagaucguggaggggcaggaccuaaucgagcucaacguagccaacgccgcggaaaucgaggccgugauccgcggcaaggacgccgacaagacccuuuacaagauggacaaggugaagaagaucgcgaaacuucuaaccgacagcaccgccaaagagcagaagaacguggccaagcagaucgccaacgccaucaugggguacaagacgcagcucgagaccauccugggcaaggagaucgacaaaaacgacaaggcccagugggaguucaaacucagcgacgccgacgacaagcuggaugcgcugcuccccgaccuggacgagagcgaccaaaccgucguugccgagaucgagaagcuguucuccgccaucacccucagcacgaucguggacgagaacaagucccugagccaguccauggucgagaaguacaacaaacaccaccaggacuauaagcugcucaaggccuacaucgagagccugcccgauagagcccaggcgaagaagcugcuucuggccuacgaccuguacgugaacaaccgccacggccaccuccuggaggcuaagaccgaguucaagcaggauaguacccugacgaaggaggacuuuuacaagacagugaaagacaaccucgacgacagcgagcuggcccauaagauagcgcaggagauagccgccgacaacuucaugcccaagcagcgaaccaacaguaacggggucaucccguuccagcugcaccaaaucgagcuggacaagaucauugccaaccaaagcaaguauuaccccuuucuggccgcggagaacccugucgaggaccaucgcaaacaggcccccuacaagcuggacgagcucgugcgcuuccgggucccguacuacgugggacccaugaucaccgccgaugagcaggagaaaaccuccggcaagagcuuugccuggauggugcgcaaggagcaggggcagaucacgcccuggaacuuugagcagaaggucgaucggcaggagagcgccaacaaguucaucaaacgcaugaccaucaaggacaccuacuugcuaggggaggacgugcugcccgcgaacucccugcuguaccaacgguucgagguccugaacgaacucaacaacauccgcgugaaugggagccggaucuccgucgaccugaagcagcagaucuuuaacgaccuguucgaagagaagaaaacagucacggagaaggcccucaucagcuaccugaagcaaaaccuucacuuaccgaccguggagaucaagggccuagccgacccaaccaaguucaacuccucucuggccuccuauuaccaucucaagaaccugcacguguucgacaaggagcuggcagacccccaguaccagaaggaguuugagaagauaaucgaguacagcuccaucuucgaggauaagaagaucuuucaggacaagcuccacgcggaguucaaguggcugaccccagcccaguucaaggccaucucaacguggcgccugcaaggguggggccggcucucccgcaagcugcugguagagcuccacgacaccaacggacaaaacaucaucgagcaacugugggacagccagaagaacuucaugcagaucgucacggagccagacuucaaagaggccaucgcgaaggagaaccagaacaucacccaagagaacggcguggaggagauacuggccgaugcuuacacgucccccgccaacaagaaggccauccggcaggucgugaagguggucgcagacguuguaaaagccgccuccggcaaggccccagcccaguucgcgaucgaguucacccgcgaccccgacaaaaacccgcagcucucacacauccgggggacgaagcugcugaaagccuaccaggagaccgcgggagagcucgucgaccagaaccugaccaacagccugaaggaggccaugacauccagaaagcuccugaaagacaaguacuuucuguauuucaugcagaccgguagagacgccuacaccggcaagaagaucaacaucgacgaggugagcaccaacuaccagaucgaccacauccucccccaguccuucaucaaggaugacucuuucgacaaccgggugcugacggcgacuccccugaacgcugagaaaucagacgacgucccguacaagcgguucgccaacaacuacguuuccgaccucaagaugaccgugggggagauguggaagcacuggcagaaggccggcaucaucaacaagcacaaguugggcaaccuguugcuggacccggacaggcugagcaaauuccagaaauccggguucaucaaccggcagcucgucgagaccagccagaucgugaagcuggugagcgucauccugcagaacaaguauccugacgcggagaucaucaccgugaaggccggcgauaacagcgcucuccggcaacgccuggaccuguacaagucccgggacgugaacgacuaccaccaugccaucgacgcauacuugaguaucgugugcgggaacuuccuguaccaaguguaccccaaguaccggccguacuucguguacgggcaguucaagaaauucucccaggaccccgacuugcagaaagaccucaucaagcacuucaagggguucaccuucauguggccccugcugcagaaagauaacagcgagcggaaagcgcucgaggagaucaaggagaacaacuccgaccgcaucgucuucuacaagcaccccgauaucuucgacaagcugagaaaggccuacaacuacaaguauaugcuagugucucgcgagacguccaccgaaagcuccaguauguucaacaugacgaucuacccgcggggagagcgcgacaggaagaaaacccgcaagcucauccccaagggcaacgggcuggaccccaagaucuauggcggguacuccggcaacaccgacgccuacauggugaucguaaaaauugagaaagccaaagagagcauuuacaaagugaucggcauccccaugcgagcccuggcggggcucaagcaggccaagaaccagggcaacuacaaggaggagcugcacaaggugguagagccgcaaaucaugcuggacaagaacgggaagcccaagcgcggcguugagggguuccggguugucaaggaccacgugcccuucaaacaggucgugcucgauggcgacaagaaguucaugcuguacagcgccaaauaugagaccaacgccaagcagcugacccucagucaggagaccaugcgcaucgugaccgauaaccugaagaaguccgaggaucaggauaagcugcucgugaaggcguaugacgagauccuacagaaggucgaccaguaccugccucucuucgacgugaacaaguuccggaacagccugcaccugggccgcgcgaaauuccucgaccuggccgugaacgauaagaagaucacccuuagcaacauccuuaacgggcugcacgacaaccuggucgugccgaaccucaagaacaucggcaucaagacgcccuucgggcugaugcagucacccagcggcaucacccuuuccagcaacgcgauccucaucuuccagucccccaccgggcuguucgagaaacgggugcgcaucgcggaccuguga

SEQ ID NO: 7889 - RNA, 4176 nt, Artificial Sequence; identical to SEQ ID NO: 2089
  Cas9 variant

SEQ ID NO: 7890 - RNA, 4176 nt, Artificial Sequence
  Cas9 variant
augaagcgcaacaacgacuacuacaucggccuggacauggggaccaauagcgugggcugggccaccacgaacccccaagggcggcuccuacgcuucaacaaaaaggacauguggggcuccagacuguucgaggaggccaagaccgcagccaagacccgaaccuuucggacgagccgccggcgcuacgaccggguacgccagcggaucgaguuccuccaggacaucuucgcccccauaaucgccaagaaggauuucgaguucuucaugcgccuuaaggaauccaaguuccaccucgaggacaaaaagaccgacgggaaguucgcccucuucaacgacgcggacuucaccgacgucgaguacuucgaucgguaucccacuaucuaccaccuucgcgccgcccugaucaagcccaaccauaucacggacccccggcuacuguaccuggccauccaccacaucaucaagaaucgcggccacuuccucuucgcuggcaccgacauggagagcauccggaguuuccagaucguguacacccagcugagcgagcaccugaaguccaucaaccucgacuucgagcugccggucgacgcccaggacaaguucgccgccauccugcucaacgagaagcugaacaagcgcgacaagaaaaagcagcugaaggaguugugcccccacaaggacaagcggcuggaauacgcuuucaacgcgaucaucgggggcaagaccaagcugaaggacaucuucgggguggaggaguacgacgagggcacgaagaaggcuguggacuucgagaaggccgacuacgacgaggacaaggacgagaucgagagcguaaucaaagagaacauccacgugcucaacgcccugaaggccguuuacgauuggaccauccugaccaacauacugggggacuacgcguacaucucggagagccagguagcccuguacgaggcccacaagaaggaccugcgaauccucaagucccugaucaagaaguacgccaagagccaguacgccgacgcguuccggcaugagaacgugaagggcaacuacgccaacuacguggguuccaccaacuacgacaacaagcagcccgucaucgacaaccccagcgugacgcaggaggacaucaacaaguacuuugccgacauccugcucuccaucaccccugacgagagcgaucgcgaguccuaucaguacaucaccgagagacugcacaaaggagaggcccugcccaagcuccggaccaaggccaacagcgugcugccccaccagauccacaagaucgagcuggagaagauccucgcgaacgcggcuaagaacuuucccuuccugcaggagaaggacuccucuggcuacacggccgcgcagaagaucgucaagaucaugauguuccgcauugaauacuacguggggccgcugaacacguaccaccacguggaccagggcggccacgcguggaugguccggaaggccgaggggaagaucacccccuggaacuucgacgagaagguggacaaggaggccagcgccgagaaguucauccgcaacaugacaaacaagugcacguaccucaucggcaaggacgugauccccaagcagucccugcuguacagccgguacaagguccucaacgagcugaauaaccugaaggugaacggggcgcccaucuccguagcccucaagcagaagaucuacgaggagcuguucaagaagcaagucaaugugaccuuuaaccagcugaagaccuuccugaagacccagggcgaggacgccgacgagaucauacucagcggggucgacgaggccgcccacaaguuuaccaacaaccugcagaccuaccacaaguuccgcgcgauccugcgggacaagaucgaguucgagccgcagcgcuccaugguggaggacauuauccgguggaagugccucaugggcgaugacaucaccauguggaagcacaagauagagaaggaguacggcgaccagcugagcgaggagcagcugaagaagaucacgcgccugaacuucaacggguggucgcggcugagccaggaguuccugacggacgugccaggcgucgacaucgagucaggggagguguacaguggcaucauggacgcccucuggcgcaccaacgagaacaucaugcagcugcugucuagccgguucaccuucgccgccgaggugaagaagcagaaccaggggaccggccgcaucgagaaaauuacguacgacgaggucaugaaggacaccuaccucucaccagccgugaagcggagcguguggcaggcgaucacccuggucgaggaaaucagaaaaauccggaaagccgaccccaagcgcaucuucguggagaugacccggcagccggacgccaagaaggagcggaaacugucccgccggacgcagcuccugaacgccuaccgcgccaucggaaacgacauagccgaguacgagaaagagcacgugagcacgcugauaacccaauuagaguccaagaaggacgaggaccugcggcgcaagaagcuguaccucuacuucacccagauggggcggugcauguacaccggcgagcguaucgaccugagcucccugcuccgggacacgaacagcaacaucuaugacaucgaccacaucuauccacgcagcuugaccaaggacgacucguuagacaacaccgucuuaugcaagaaggaaaucaaccugaagaaggggaacaaguacauccaccggguuuucaccgacaaagagcugaagaagcaguacggcuacuggaaggcccucaaagagaagaagcugaucagcgagcgcaaguucuccagauuaaugcgcacgaccgaucucaccgccgacgagcuggccggguucaucucgcggcagcugguggagacgucccagauggucaaggcgacggccgacauccucgagaagauauaccccaacgucaccaucguguacguaaaagcccgcaccguuagcgacuuccggcacgacuacgagcugcccaaagugcgcgcccugaaugacugccaccacgcccacgacgcguaccucaacaucguggugggcaacguguacuacgagaaguucacuaagucccccuuccgguucaucgccaaucagaagggcaagggagacaucaaguacaaccuguaccgccuguucgacaaggacgugaaagugggcgaccggaucaucuggaacgccaaggaagaccuagccagagugaaggccacgcucgaacgggacaccgugaacgugguacgcaugcccgucgagcagcgcggacaguucuucgacgcgacaauccagaagaaagguaccacgaagaacaugcuggugcuuccccugaagggcagcgacgaacggcugcaggacaccuccaaguacggguacuacgugcggcccucuggcauguccuucauggucgugcagcacgaggugaagggcaagagccgagucaccaucgagccggcccucuuggucuacaagaacaagcugaaguccgaggacgacuacgccaaguauugcgaggacgugcucaagcugcagaagccuaagguccuguucaagaacaucaaguucgggucgaagauacucuucgacggguaccccuuccuccugaaaggccgcaccgagaaucggaucauuauggccgacgcgcagucccuuuuccugggcaaccaggagcuaaagauccucaagcgcguuacgaaaaucagcgacgacaucgaccacaagguggagucccggaucaagaucaccgacgaggaguggacgacccuguggaaguccgucguggagcagaucgugacggggaaguuccgcaaccggcugggcacccucaacgggauccugcagggccgcaaaaucaagcugucaaaggacgaggaagcccggcucaacgagcuggacagcaaggaccaggagaccuuccugagucagauccuucuggagcgcuuccuccaguucuccaccgaggagaagacgcggcuccugcugcagguuaucagcuucuccgggaacaccaccggcguggaccuccgccugaucggcgggagcaguggcaccgggacgaucaagaccaacaagaacauuacugaccacagcgugauccuaaucaacgaguccccgaccggccucuucacgaacagaacggugcugaaccagcccuga

SEQ ID NO: 7891 - RNA, 4176 nt, Artificial Sequence
  Cas9 variant
augaagcgcaacaaugacuacuacaucggccuggacauggggaccaacagcgugggcugggccaccacgaacccccaggggcggcuccugcgcuucaacaagaaggacauguggggcucccggcuuuucgaggaggccaagaccgcggccaagacccgcaccuuccggaccagccgccggagguacgaccggguccgccagcggaucgaguuccuccaggacaucuucgccccuaucaucgccaagaaggacuucgaguucuucaugcgccugaaggaguccaaguuccaccuggaggacaagaagaccgacgggaaguucgcccucuucaacgacgcggacuucaccgacguggaguacuucgaccgguaccccaccaucuaccaucuccgcgcagcccuuauaaagcccaaccacaucacggauccccggcugcuguaccuggccauccaccacaucaucaagaaccggggccacuuccucuucgcgggcaccgacauggagagcauccgguccuuccagaucguguacacccagcugagcgagcaccugaaguccaucaaccucgacuucgagcugccggucgacgcacaggacaaguucgccgccauccuacucaacgagaagcugaacaagcgcgacaagaagaagcagcugaaggagcucugcccccacaaggacaagcggcuggaguacgccuucaacgcgaucaucgggggcaagaccaagcugaaggacaucuucgguguggaggaguacgaugagggcaccaagaaggccguggacuucgagaaggccgacuacgacgaggacaaagacgagaucgagagcgucaucaaggaaaauauccacgugcuaaacgcccugaaagccguguacgacuggaccauccugaccaacauccucggggacuacgcguacaucuccgagagccaggucgcucuguaugaggcccacaagaaggaccugcgcauccucaagucccugaucaagaaguacgccaagagccaguacgcagacgcguuccggcacgagaacgugaaaggcaacuacgcuaacuacgugggcuccaccaacuacgacaacaagcagcccgucaucgacaaccccagcgugacacaggaggacaucaacaaauacuucgccgacauccugcucuccaucaccccggacgagagcgaccgcgaguccuaucaguacaucaccgagcgccugcacaagggggaggcccugcccaagcuccggaccaaggccaacagcgugcugccccaccagauccacaagaucgagcuggagaagauccucgcgaacgccgccaagaauuuccccuuucugcaggagaaggacuccagcggcuacacggccgcgcagaagaucgucaagaucaugauguuccgcaucgaguacuacguggggccgcugaacaccuaccaccacguggaccagggcggccacgccuggaugguccggaaggccgaagggaagaucacgcccuggaacuucgacgagaagguggacaaggaggccagcgccgagaaguucauccgcaacaugaccaacaagugcacguacuugaucggaaaggacgugauccccaagcagucccugcuguacagccgguacaagguccucaacgagcugaacaaccugaaggugaacggggugcccaucuccgucgcgcucaagcagaagaucuacgaggagcuguuuaagaagcaggucaacgugaccuuuaaccagcugaagaccuuccugaaaacccagggcgaggacgccgacgagaucauccucagcgggguggacgaggcagcccacaaguucacgaacaaccugcagacauaccacaaguuccgcgccauacugcgggacaagaucgaguucgagccgcagagguccaugguggaggacaucauccgguggaagugccucaugggcgacgacaucaccauguggaagcacaagaucgagaaggaguacggcgaccagcugagcgaggagcagcugaagaagaucacccgccucaacuucaacggguggucccggcugucacaggaguuccugacggacguccccggcguggacaucgaguccggggaaguguacagcggcaucauggacgcgcucuggcgcaccaacgagaacaucaugcagcugcuguccagccgguucaccuucgccgccgaagucaagaagcagaaucaggggaccggccgcaucgagaagaucacguaugacgaggugaugaaagacaccuaccucucccccgccgugaagcggagugucuggcaggccaucacccugguggaagagauccgcaagauccggaaggcggaccccaagcgcaucuucguggagaugacccggcagccggacgccaagaaggagcgcaagcugucccgccggacccagcuccugaacgcguaccgcgccauaggaaacgacaucgcggaguacgagaaggagcacgucuccacgcugaucacccagcucgaguccaagaaggacgaggaccuccggcgcaagaagcuguaccucuacuucacccagauggggcggugcauguauacgggcgagcgcaucgaccugagcucccugcuccgggacacgaacagcaacaucuacgacaucgaccacaucuacccucgcagccugaccaaggacgacuccuuagacaacacagugcucugcaagaaagagaucaaccugaagaaggggaacaaguacauccacagaguguuuacagacaaggagcugaagaagcaguacggcuacuggaaggcccucaaggagaagaagcugaucagcgagcgcaaguuuucccggcugaugcgcacgaccgaccugacggccgacgagcuggccggguuuaucagccggcagcucgucgagaccucccagauggugaaggccacggcggauauccucgagaagaucuaccccaacguuaccaucguuuacgugaaggccaggaccgugagcgacuuccggcacgacuacgagcugcccaagguccgcgcccugaacgacugccaccacgcccacgacgccuaccucaauaucguggugggcaacguguacuacgagaaauucaccaaguccccguuccgguucaucgcgaaccagaagggcaagggggacaucaaguacaaccuguaucgccuguucgacaaggacgugaaggugggcgaccggaucaucuggaacgccaaggaggaccucgcccgcgucaaggccacgcuggagcgggacaccguaaacgugguccgcaugcccguggagcagcgcgggcaguucuucgacgccaccauccagaagaagggcaccacgaagaacaugcuggugcucccccugaaaggcagcgacgaacggcugcaggacaccucgaaguacggguacuacguccgccccagcggcauguccuucauggucgugcagcacgaggucaagggcaagagccgggugaccaucgagccggcgcuccugguguacaagaacaaacuuaagagugaggacgacuacgccaaguacugcgaggacguccucaagcugcagaagcccaaggugcuguucaagaacaucaaguucgggagcaagauccucuucgacggguacccuuuccugcugaagggacgcaccgagaaccggaucaucauggccgacgcccagucccucuuccugggcaaccaggagcugaagauccucaagcgcgugacgaaaaucagcgacgacaucgaccacaaggucgagucccggaucaagaucaccgacgaggaauggaccacccuguggaaguccgugguggagcagaucguuacggggaaguuucgcaaccggcugggcacccucaacgggauccugcagggccgcaagaucaagcugagcaaggacgaggaggcgcggcucaacgaguuagacagcaaggaccaggagaccuucuuaagccagauccuccuggagcgcuuccugcaguucuccaccgaggagaagacgcggcuccugcuccaggugaucagcuucuccgggaacaccaccggcguggaccuucgccuaaucggcgggagcuccggcaccgggacgaucaagaccaacaagaauaucaccgaccacagcgucauccugaucaacgaguccccgacaggccucuucaccaaucggacggugcugaaccagcccuga

SEQ ID NO: 7892 - RNA, 4179 nt, Artificial Sequence
  Cas9 variant
augaaguccauacugggguuagaccucggaaccacgagcaucggcugggcccuggugaaggaaagcgagaacgacaacgagaaguccgaaaucgucaaguuggggguacgucuggugccccugacgaccgacgagcguaccgacuucgaaaaggguaagagcauuaccacgaacgccgauagaaccuccaagcgguccaugcgccgaaaccuccagagauacaagcugagacgggaggcgcuggucagcgaacucaaaaaggagcacuggaucgacgagggguaucgcuuuuccgaggacggcccgggcuccaccuucagcacgcugcgccuucgggccaaggcagccgaggaggagaucucccuccaggaccuggccaaggugcuauugcagauaaacaagaagcguggguacaagagcucccggaagcucaacagugcggaggacggccaagccaucgacgggauguccgucgcgaagguucuguacgaccgcggucucacgccgggggaguauguguaucagcggaugcuggacggucaguacgcgauccccgaguucuacaagucagaccugcaggcagaguucgacaaaauauggaaccuccagaagucauauuaucccgagcugaccgccgagcuguacgacaaacucacugacaaaaacaagagucagacaugggccaucugccgcgacgagcuaggcgugcagggguuuaaauccucauucacgggaaaggaacggcugaaggaggcauauuuuaaccgccaacaagccagcaagcagaaaguggaccuagaggugcuuaccugcguucugcaggacaucaacgggcagaaggcgucccuaucaggccuuuugucagccaucagcgacagguccaaggaacucuacuuuaaccgcaugaccgucggacagaugcuagugcggcaaauccaggaggacccgaaccgcagcuuacgcaacacaguauuuuaccgccaggauuacaucgacgaguucgagaagaucuggucaguccaaucucgcuuccaccccgagcuuacgcaggagcguaaaaagaagcugaaggauaucauuauuuucuaccagcgcccccugaagucccaaaaggggcugauuagcuuaugcgaguucgaaucccgggaggucgacaucuccguggauggagucaucaagaaaaagaagaucgggccccgcgugugcccucgguccagcccccuauuccaggaguucaagguguaccaaacgguaaauaacauacucgugaacggcgaaccccuagacgacaacgaccgcgagaagcugguuggggaguuagcuuuccgugagaagaugaaaggccaagacguccuuaaacuccuguauaagacguccaagggcaugcgaauuaacuuugaggaggucgagggcaaccggaccauggccacgauacugaaggccugcgagaagaucgucgagggccucgguuacgacacccgcgaccugagcaagaucaccgcguccgaaaagguaagccggaucgaggagaucuucgccaaggaaggcuuuaaaucggacuuccuccacuuugacucaagccugccgucucccgaguucgagagccaggccuccuacucgcuguggcaucuucuguauuccuacgaaaacgacaaaucgguuuccgggaacgagagccuggucgagaagaucaagaagcucugcuccauggacgaagcgucagcuaagauacugucgggcugcaccuuccugagcgauuacggcucacuuucagcgcgcgccaugcggaagauccugcccuauaugaaggacgggcuggaauauagugccgccugcgccauggcgggcuaccgccacagcaagcggucccucaccaaggaggagcuggacagccgcguguacguagaccgguuagaacuccuccccaaaaacagucugcgaaacccaguugucgagaagauccucaaccagaugaucaauguggucaauaguguuguugacaccuacgggaagccggaugagauccggauagagauggcccgagaacugaagaagucggcgucagagagggagaaggcacagaaggacauugcugcggccagcaaggucaacgaguccaucguugccacccugaagggcucuccauucuuuaucgacucucccagccgaaacgacaucaucagguaccggcucugggaggagcugaaaccaaacggguauaagacccuguacagcggcaccuacauaccuaaggagcgccuguucagcaaggacuucgacaucgagcacaucauuccccaagcacugcuguucgaugacucauucgcgaacaagacaaucgagagccggcagugcaacauagagaaguccaaccgcacggccauggauuacgucaagagcaaauacgacuccuucggcgugcaggcuuacaucgaucgugugaaggggcucaccgguguguccaagacuaaaaucacacgacugcugauggagucaaaagacauccccgaagauuucauaaaucgagagcuccgcgacagccaguacauagcccgaaaggcccgggagauccuggaguccauggucaaguucguggugcccaccaccgggagcguuaccgcgcggcugcgcgaggacuggcagcucgugaacgugaugcgggagcugaacugggacaaguacgagaaacugggccucaccagcuuucgcgaggaccgcgacggccgcgaaaucccggugaucgaggauuggaccaagcggaacgaccaucgccaccacgccauggacgcgcugaccaucgccuucacccgccggcaguucauccaauaccugaaccacuuaaacgcgaagaucgacacgguggacaagaccgacauagaccuacgcgacuacaacuuggaggauauaucuuucgacgggcuacgggacggggacaaguucggaaucgugaaggcacugcagaagaaguaccuguacaaggacgacaagcagaaauaccgcuucgugccgccaaugccucucgacgaguuccggauugaagcuaagcgccagaucgaggacgugcuggugagcuucaaggccaagaacaaggucugcaccaagaacgugaauaccacaaaggugcgcgggggccagcagcgaaaaauacagcugacaccucgaggcccccuucacgaagacacgaucuacggcaagcgccugcaguaugucaccaaggaagagaaggucgggggcuccuucgaugaggccaagaucgcuagcguaugcaaaaagagcuacagagaggcuuuaaugcggcggcucauggagugcggaggcgaucccaagaaggcguucaccggaaagaacagccuggagaagaacccgguguggguggacgaguuccacaguggugaagugccccugcgcguccggacagugucaauggcguccguuuacaccguccgcaagagcgugggccagucgcugaacaucgaaaagguccuggacaagcacaucaaggagauccugcgggcccgccuggaagaguacggggguaacgcgucaaaggcguucuccaaccuggaugaaaaccccaucuggcuuaauaaagagaagggcaucgccgucaagcguguuaccaucgauagcggcaagaacccuaucccgcuccgcuccaaguuagacaaggacgggcagauaaucuauggcgaaggccaaaacccccaggagagcgacuuuguuguccccgggggcaaucaccacgcagccaucuaucgaacgcccucgggcaaacuucaggacgugguggucuccuucuacgaggcggugagcaggaagaaccucggacuggaagugaucgaucgcaacuucaagaaggacgaagggugggaguuccuguucacccucaagcagaacgaauacuucguguucccgaaucccgccacuggcuuuucacccgaagauuacgacuugaccgaucccgccaauaacgccaucaucagccccaaccuguaccggguacagacggucuccgugggcgacuaucgcuuccggcaccaccuugaaaccacuguggaggacaacgagaagcugcgcgacaucgccuggaagcggauagggcccagcggcuuaguaggggcgguuaagguucgcaucgacaaccucggccggauccuugccgucggugaguacgacuga

SEQ ID NO: 7893 - RNA, 4179 nt, Artificial Sequence
  Cas9 variant
auggagaacaagaacuacagcaucggccuggauaucgggaccaacuccgucggcugggccgucaucaccgacgacuacaaggugcccagcaagaagaugaagguguucgggaacacggacaagcacuucaucaagaagaaccucaucggcgcccugcuguucgacgagggggcgaccgccgaggaccgccggcucaagcguaccgcccgacgccgguacacccgccggaagaaccgccugcgguaccugcaggagaucuucuccgaggagaucagcaagcucgacuccagcuucuuccaccgccuggacgacuccuuccuggucccgaaggacaagcguggcagcaaguaccccaucuucgccacgcucgaggaggagaaggaguaccacaagaaguuccccaccaucuaccaccuccgcaagcaccuggccgauuccaaggagaagaccgaccugcggcugaucuaccuggcgcucgcccacaugaucaaguaccgcggccacuuccuguacgaggagagcuucgacaucaagaauaacgacauccagaagaucuucaacgaguucaucuccaucuacgauaacaccuucgaggggagcucccucagcggccaaaacgcccagguggaggccaucuucacagacaagaucuccaagagcgcgaagcgggagcgcgugcucaaacucuucuccgacgagaaguccacgagccuguucagcgaguuccucaagcugaucgucgggaaccaggccgacuucaagaagcacuucgaccuggaggagaaggcgccccuccaguucagcaaggacaccuacgacgaggaccuggagaaccugcucggccagaucggggacggcuucaccgaccuguuccugguggccaagaagcucuacgacgccauccugcuguccggcauccucacggugaccgacccgagcaccaaggcgccccuuucggccagcaugaucgagcgguacgagucccaccagaaggaccuggccgcccucaagcaguucaucaagaacaaccugcccaagcgcuacaacgaggucuucagcgaccaguccaaggacgguuacgccggcuacaucgacgggaagacgacgcaggaggcguucuauaaguacauuaagaacuugcucagcaaguucgagggcgcagacuacuuccuggacaagaucgagcgggaggacuuccugcgcaagcagcggaccuucgacaacggcucgaucccccaccagauccaccuacaggagaugaacgccauccugcgccgccagggggagcacuacccguuccugaaggagaaccgggagaagaucgagaagauccucaccuuccgcauccccuacuacgugggcccccuggcccgggggaaccgcgacuucgccuggcugacccggaacagcgaccaggcgauccgccccuggaacuucgaggagaucguggacaaggccuccagcgccgaggaguucaucaacaagaugacgaacuacgaccucuaucugccagaagagaagguccugccuaagcacagccugcucuacgagaccuucgccguguacaacgaguugaccaaggugaaguucaucgccgagggccugcgggacuaccaguuccucgacagcgggcagaagaagcagaucgucaaccagcuguucaaggagaagcgcaaggugaccgagaaggacaucauccacuaccugcacaacguggacggcuacgacggcaucgagcucaaggggaucgagaagcaguucaacgcgucccugagcacauaucacgaucugcucaagauaaucaaggacaaagaguucauggacgaccccaagaacgaggagauccuggagaacaucguccacacccugaccaucuucgaggaccgggaaaugaucaagcagcgccucgcccaguacgacaguaucuucgacgagaaggugaucaaagcccugaccaggcgccauuacacgggcugggggaagcugagcgccaagcucaucaacggcaucugcgacaagcagaccggggacaccauccuggacuaccugaucgacgacggcaagaucaaucggaacuucaugcagcucaucaacgacgacggccuguccuucaaggagaucauccagaaggcccagguggucgggaagaccgacgacgugaagcaggucgugcaggagcugcccggcagcccggccaucaagaaggggauccuccagucaaucaagaucguggacgaguugguuaaggucaugggcuacgccccugaguccaucgugaucgagauggcacgcgagaaccagacgaccgcccgggggaagaagaacagccagcagcgauacaagcggaucgaggacucccugaagaaccucgcgcccggccuggacagcaacauccugaaggagaaccccaccgacaacauccagcuccagaacgaccgccuguuccuguauuaccuccagaacggcaaggacauguacaccgggaagccgcuggacaucgaccagcuguccuccuacgacaucgaccacaucauuccccaggccuucaucaaggacgacuccauagacaaccggguccucacaagcuccaaggacaaccgcggcaagagcgacaacgugcccucccuggaggugguccagaagcgcaaggccuucuggcagcagcugcucgacagcaagcugaucucagaacggaaguucaacaaccugaccaaggccgagcgcggcggccucgacgagcgggacaaggugggcuucauccgccggcagcugguggagacccgccagaucacuaagcacgucgcccagauccuggacgcgagcuucaacaccgaggugaacgagaagaaccagaagauccggacggugaagaucaucacccucaaguccaaccuggucucgaacuuccgcaaggaguucgagcuguacaaggugcgggagaucaacgacuaccaccacgcccaugacgccuaucucaacgccguugucgccaaggcgauccugaaaaaguacccaaagcuggagccggaguucguguacggggacuaccagaaguacgaccucaagcgcuacaucucccgguucaagcccucuaaggagauagagaaggccacugagaaguacuucuucuacagcaaccugcugaacuucuucaaggaggaggugcacuacgccgacggcaucaucgucaagcgcgagaacaucgaguacuccaaggacaccggggagaucgccuggaacaaagagaaggacuucgcgacgaucaagaaggugcucagcuacccccaagugaacaucgucaagaagaccgagauccagacccacggccuggaccgggggaagcccaagggccuguucaacuccaacccgagccccaagcccucugaggacagcaaggagaaccucgugccgauuaaacagggccuggacccccgcaaguacgggggcuacgccgggaucuccaacagcuacgccguacuggucaaggccaucguggagaagggggccaagaagcagcagaagacaauccucgaguuccaggggaucuccauccuugacaagaucaacuucgaaaacaacaaagagaacuaccugcucaagaagcgguacaucgagauccugagcacgaucacccugcccaaguacucccucuucgaguuccccgacggcacccgcaggcgccuggcgagcauccuguccaccaacaacaagcggggcgagauccacaaggggaacgagcucgugcucccgggcaaguacacgacccugcucuaccacgccaagaacaucaacaagaagcuggagcccgagcaccuggaguacgucgagaagcaccgcaacgacuucgccaagcuccuggagugcgugcugaacuucaacgacaaguacgugggggcccucaagaacggcgagcggauccgccaggccuucaccgacugggagaccgucgacaucgagaagcugugcuucucuuucaucgggcccgagaacuccaagaacgcgggccuguucgagcucacgagucagggcuccgccagcgacuucgaguuccugggggugaagaucccccgcuaccgggacuacgccccguccagcuuacugaaggccacccugauccaccagagcaucaccggccuguacgaaacccgcaucgaccucaguaagcugggggaggacuga

SEQ ID NO: 7894 - RNA, 4179 nt, Artificial Sequence
  Cas9 variant
augaacaacaacaacuacagcaucggccuagacaucgggaccaacuccgugggcugggccgucaucaccgacgacuacaagguucccagcaagaagaugaaggugcucgggaacacugacaagcacuucauaaagaagaaccugaucggcgcccuccucuucgacgagggggcgaccgccgaggacagacgguucaagcgcaccgcccggcgccgguacacccgccggaagaaccgccugcgguaccugcaggagaucuucuccgaggagaugagcaaggucgacuccagcuucuuccaccgccucgacgacuccuuccugguuccugaggacaagcggggcagcaaguaccccaucuucgccacgcuggccgaggagaaggaguaccacaagaaguuccccaccaucuaccaccuccgcaagcaccuggcggacuccaaggagaagaccgaccugcggcucaucuaccuggcccuggcccacaugaucaaauaccgcggccacuuccucuacgaggagagcuucgacaucaagaacaacgacauucagaagaucuucuccgaguucaucagcauuuacgacaacaccuucgaaggguccagccuguccggccagaacgcccagguggaggcgaucuucacggacaagauuagcaaguccgccaagcgggagcggauccugaagcuguucgcuuacgagaaguccaccgaccuguucagcgaguuccugaagcucaucgucgggaaccaagccgacuuuaagaagcacuucgaccuggaggagaaggcgccccugcaguucagcaaggacaccuacgacgaggaccucgagaaccugcugggccaaaucggggacgacuucgccgaccucuuccugguggccaagaagcuguacgacgccauccuccugagcggcauccugaccgugacggacuccagcaccaaggcgccccucuccgccagcaugaucgagcgguacgagaaccaucagaaggaccuggccgcccugaagcaguucauccagaacaaccuccaagagaaguacgacgaggucuucuccgaccagagcaaggacggcuaugcccgcuacaucaaugggaagaccacccaggaggccuucuauaaguacaucaagaaccugcuguccaaguucgagggcagcgacuacuuccucgacaagauugagcgggaggacuuccugcgcaagcagcggacguucgacaacggguccaucccccaccagauccaccuccaggagaugaacgcaaucauccgccggcagggcgagcauuaucccuuccucaaggaguacaaggagaaaaucgagaccauccugaccuuccggauccccuacuaugugggcccgcuggcgcgcgggaaccggaacuucgccuggcucacccgcaacagcgaccaggccauccggccguggaacuucgaggagaucguggaccaggccuccagcgccgaggaguucauuaacaagaugaccaacuacgaccuauaccugcccgaggagaaaguccuccccaagcacucccuguuauacgagaccuucgcgguguacaacgagcugaccaaggugaaguucaucagcgagggccuccgcgacuaccaguuccuggacuccgggcagaagaagcagaucgucaaccagcuguucaaggaaaagcggaaggugaccgagaaggacaucauccaguaccuccacaacguggacggcuacgacgggaucgagcugaagggcaucgagaaacaguucaacgccagccuguccacguaccaugaccuccugaagaucaucaaggacaaggaguucauggacgauccgaagaacgaggagauccuggagaacaucguccacacccucaccaucuucgaggaccgcgagaugaucaagcagcggcuggcccaguacgccagcaucuucgacaagaaggugaucaaggcgcugacccgccggcacuacacgggcugggggaagcucuccgccaagcugaucaacggcaucugcgacaagaagaccgggaagaccauccuggauuaccucaucgacgacggcuacagcaaccgcaacuucaugcagcugaucaacgacgacgggcugagcuuuaaggacaucauccagaaggcccagguggucggcaaaacuaacgacgugaagcaggucgugcaggagcuccccggcucccccgccaucaagaaggggauccugcagagcaucaagcugguggacgagcucguaaagguuaugggccacgcccccgaguccaucgugaucgagaucgcgcgggagaaccagacgaccgcccgcgggaagaagaacagccagcagagauacaagcgcaucgaggacgcccugaagaaccuggccccgggccucgacuccaacauucugaaggagcaccccaccgacaacauccagcuccagaacgaccggcuguuccuguacuaucugcagaacgggaaggacauguacaccggcgaggcccucgacaucaaccagcugagcuccuacgacaucgaccacauugucccccaggcguucaucaaggacgacagccuggacaaccgcgugcucacguccagcaaggacaaccggggcaagucggacaacgugcccagccuggaagucguacagaagcgcaaggccuucuggcagcagcugcucgacuccaagcugaucagcgagcacaaguucaacaaccugaccaaggccgagcgcgguggccucgacgagcgggauaaagugggguucauccgccggcagcuggucgagacccgccagaucaccaagcacgucgcccaaauccuggacgcccgguucaacaccgaggugaacgagaaggacaagaagaaccgaacggucaagaucaucacccucaaguccaaccucgugagcaacuuccggaaggaguucaagcuguacaaggugagagagaucaacgauuaccaccacgcucacgacgccuaccucaacgccgucguggccaaggcgauccuuaagaaguacccgaagcuggagcccggcuucguguacggcgacuaccagaaguacgacaucaagcguuacaucucccgcagcaaggaccccaaggaggucgagaaggcaaccgagaaguacuucuucuacagcaaccuccugaacuucuucaaggaggaggugcacuacgccgacgggaccaucgugaagcgggagaacaucgaguacuccaaggacacgggcgagauagccuggaacaaagagaaggacuucgccaccaucaagaagguccugucacucccccaggugaacaucgugaagaagaccgagauccagacccacgggcuggaccgcggcaagccgcgggggcuguucaacuccaaccccagccccaagcccagcgaggaccgcaaggagaaccucgucccgaucaagcagggccuggacccccggaaguacggcggguacgcgggcaucagcaacucauacgccgugcuggugaaggccaucaucgagaagggggccaagaaacagcagaagacgguccucgaguuccagggaaucagcauccuggacaagaucaacuucgaaaagaacaaggagaacuaccugcucgagaagggguacaucaagauccuguccaccaucacccugcccaaguacagccucuucgaguucccggacggcacccgccggcgccuggccuccauccugagcacgaacaacaagcggggcgagauccacaaggggaacgagcucgugauccccgagaaguauaccacccugcuguaccacgcgaagaacaucaacaagacccucgagcccgagcaccuggaguacguggagaagcaccgcaacgacuucgccaagcugcucgaguacguccugaacuucaacgacaaguacgugggagcccugaagaacggggagcggauccgccaggccuucaucgauugggagacgguggacaucgagaagcucugcuucuccuucaucggcccccgcaacagcaagaacgccgggcuguucgagcugaccucccagggcagcgcguccgacuucgaguucuugggcgucaagaucccgcgguaccgcgacuacacccccagcucccugcugaacgccacccucauccaccagaguaucacggggcuguaugagacccggaucgaccugagcaagcucggcgaggacuga

SEQ ID NO: 7895 - RNA, 4179 nt, Artificial Sequence; identical to SEQ ID NO: 2095
  Cas9 variant

SEQ ID NO: 7896 - RNA, 4179 nt, Artificial Sequence; identical to SEQ ID NO: 2096
  Cas9 variant

SEQ ID NO: 7897 - RNA, 4179 nt, Artificial Sequence; identical to SEQ ID NO: 2097
  Cas9 variant

SEQ ID NO: 7898 - RNA, 4179 nt, Artificial Sequence
  Cas9 variant
augaacaacaacaacuacagcaucggccuggacaucgggaccaacuccgugggcugggccgucauuaccgacgacuacaagguucccuccaagaagaugaaggugcucgggaauacggacaagcacuucaucaagaagaaccugaucggcgcccuccucuucgacgagggggcgaccgccgaggaccgccgguucaagcgcaccgcccggcgccgguacacucgccggaagaaccgcuuacgguaccugcaggagaucuucuccgaggagaugagcaaggucgacuccagcuucuuccaccgccucgacgauuccuuccuggugccggaggacaagcggggcagcaaguaccccaucuucgccacgcuggccgaggagaaggaguaccacaagaaguuccccaccaucuaccaccucagaaagcaccuggcggacuccaaggagaagaccgaccugcggcucaucuaccuggcccuggcccacaugaucaaguaucgcggccacuuccucuacgaggagagcuucgacaucaagaacaacgacauccagaagaucuucuccgaguucaucagcaucuacgacaacaccuucgagggguccagccuguccggccaaaacgcccagguggaggcgaucuucacggauaaaaucagcaaguccgccaagcgggagcgcauccugaagcuguucgccuacgagaaguccaccgaccuuuucagcgaguuccugaagcucaucgucgggaaccaggccgacuucaagaagcacuucgaccuggaggagaaggcgccccugcaguucagcaaggacacauacgacgaggaccucgaaaaccugcugggccagaucggggacgacuucgccgaucucuuccugguagccaagaagcucuacgacgccauccuccugagcggcauccugacugugacggacuccagcacaaaggccccgcucuccgccagcaugaucgagcgguacgagaaccaccagaaggaccuggcggcccugaagcaguucauccagaacaaccuacaggagaaguacgacgaggucuucuccgaccagagcaaggacggcuacgcccgcuacaucaacgggaagaccacacaggaagccuucuacaaguacaucaagaaccugcuguccaaguucgagggcagcgacuacuuccucgacaagaucgagcgggaggacuuccugcgcaagcagcggacguucgacaacggguccaucccccaccagauccaccuccaggagaugaacgccaucauccgccgccagggcgagcacuaccccuuucucaaggaguacaaggagaagaucgagaccauccugaccuuccggauccccuacuacgugggcccauuggcgcgcgggaaccggaacuucgccuggcucacccgcaacagcgaccaggccauccggcccuggaacuucgaggagaucguggaccaggccuccagcgccgaggaguucaucaacaagaugacgaacuacgaccuuuaccugccagaggagaagguccuccccaagcacucauugcuguacgagaccuucgcgguguacaacgagcugaccaaggugaaguucaucucugagggccuccgggacuaccaguuccuggacuccgggcagaagaagcagaucgucaaccagcuguucaaggagaagcggaaggugaccgagaaagacaucauucaguaccuccacaacguggacggcuacgacgggaucgagcugaagggcaucgagaagcaguucaacgccagccuguccacguaccacgaccuccugaagaucaucaaggauaaggaguucauggacgacccgaagaacgaggagauccuggagaacaucguccacacccucacgaucuucgaggaccgcgagaugaucaagcagcggcuggcccaguacgccagcauauucgacaagaaggugaucaaggcguuaacccgccggcacuacacgggcugggggaagcucuccgccaagcugaucaacggcaucugcgacaagaagacagggaaaaccauccuggauuaccucaucgacgacggcuacagcaaccgcaacuucaugcagcugaucaacgacgacgggcugagcuucaaggacaucauccagaaggcccagguggucggcaagaccaacgacgugaagcaagucgugcaggagcuccccggcucccccgcaaucaagaaggggauccugcagagcaucaagcugguggacgaauuagucaaggugaugggccacgcccccgaguccaucgugaucgagaucgcgcgggagaaccagacgaccgcccgcgggaagaagaacagccagcagagauacaaacgcaucgaggacgcccugaagaaccuggccccgggccucgacuccaacauccugaaggagcaccccaccgacaacauccagcugcagaacgaccgucuguuccuguacuaccugcagaacgggaaggacauguacaccggcgaagccuuggacaucaaucagcugagcuccuacgacauagaccauaucgucccccaggcguucaucaaagacgacagccuggacaaccgcgugcucacguccagcaaggacaaccggggcaaguccgacaacgugcccucccuggaagucgugcagaagcgcaaggcuuucuggcagcagcugcucgacuccaaacugaucagcgagcacaaauucaacaaccugaccaaggccgagcgcggcggccucgacgagcgggacaaggugggguucauccgccggcagcugguggagacccgacagaucaccaagcacguggcccagauccuggacgcccgguucaacaccgaagugaacgagaaggacaagaagaaccgcacggucaagaucauuacccucaaguccaaccuggugagcaacuuccggaaagaguucaagcuguacaaggugcgcgagaucaacgacuaccaccacgcgcacgacgccuaccucaacgccgucguggccaaggcgauccugaagaaguacccgaagcuggagcccgaguucguguacggcgacuaccagaaguacgacaucaagcgguacauaucccgcagcaaggaucccaaggaggucgagaaggccaccgagaaauacuucuucuacagcaaccuccugaacuucuucaaggaggaggugcacuacgccgacggcacuaucgugaagcgggagaacaucgaguacuccaaggacacgggggagaucgccuggaacaaggagaaggacuucgccaccaucaagaagguccugagccucccccaggugaacaucgugaagaaaaccgagauccagacccacggccuggaccgcgggaagccacggggccuguucaacagcaaccccagccccaagcccuccgaggaccgcaaggagaaccucgucccgaucaagcaggggcuggacccccggaaguacggcggcuacgcggggaucagcaacuccuacgccguucuggugaaggccaucaucgagaagggcgccaagaagcagcagaagacgguccucgaguuccaggggaucagcauccuggacaagaucaacuucgagaagaacaaggagaacuaccugcucgagaagggcuacaucaagauccuguccaccaucacccugcccaaguacagccucuucgaguucccggacgggacccgccggcgccuggccuccauccugagcacgaacaacaagcggggcgagauccacaagggcaacgagcucgugauccccgagaaguacaccacccugcuguaccacgcgaagaacaucaacaagacccuagagcccgagcaccuggaguacguggagaagcaccgcaacgacuucgcuaagcugcucgaguacguccugaacuuuaacgacaaguacgugggggcccugaagaacggcgagcggauccgccaggccuucaucgacugggagacuguggacaucgagaagcucugcuuuuccuuuaucgggccccgcaacagcaagaacgccggccuguuugagcucaccucccaggggagcgcguccgacuucgaguuccucggcguuaagaucccgcgguaccgcgauuacacucccagcucacugcugaacgccacccucauccaccagagcaucacgggccuguacgaaacccggaucgaccugagcaagcucggggaggacuga

SEQ ID NO: 7899 - RNA, 4182 nt, Artificial Sequence
  Cas9 variant
augaagcgcgugaccgaggacuacauucugggcuuggacaucgggaccaacagcugcggcugggccgucacggacaagaagaacaaccuucugaagcuccggggaaagaccgccaucggcucccaccuguucgaggaaggucacaccgcggccgaccgccggggcuuccguaccacgcggcggcggcugaagcgcaggaaguggcgccuccggcugcuggaggaaaucuucgccgagcccauggccaagguggacccgggcuucuucguucgccuccaccagagcugggucagcccccuggacaagagccgcaagaaguaccacgccaucguguuccccaccgcgaaggaagacaaggccuucuaccagaaguacccuaccaucuaccaccuccgcgacgcccucaugacucaggaccggcaguucgaccugcgcgagaucuuccuggccauccaccacaucgugaaguuccgggggaacuuccuccaggacacgccggucaaagacuucgaggcguccaagaucgaggugggccccauccuuagcaagauaaacggggccuucgccgagaagauuguggaggaccaggaccccaucgagcugaacguagccaacgccgcggagaucgaagccgugauccguggcaaggacgcagacaagacccucuacaagauggacaaagugaagaagaucgccaagcugcugaccgacuccaccgccaaggaggagaagaacguugcgaagcagaucgccaaugccgucaugggcuauaagacgcaguucgagaccauccucgggaaggagauagacaagagcgacaaggcccagugggaguucaagcugaccgacggcgacgccgacgacaagcuggaggcccuccugcccgaccuggacgagaacgaucagaccaucaucgcagaaaucaagaaguuguucuccgccaucacgcugagcaccaucguggacgagaauaagucccugucccaguccauggucgccaaguacaacaagcaccaccaggacuacaaacuucugaaggccuacaucgacacccugcaggaucggagcaucgcgaagaagcuccuuuuggccuacgaccucuacgugaacaaccgccacgggcgguugcuggaagccaagacugaguuuaagcaggacggcacacucaccaaggaagacuucuacaagaccgugaaggacaaccuggacgacuccgagcuggcccgcaagaucgcgcagaagaucgccgccgacaacuucaugccaaagcagcgcaccaacagcaacggugucauccccuuucagcuccaccagaucgagcucgacaagaucaucgccaaucagagcaaguauuauccauuccuggcagcggagaaccccguggaggaccaccggaagcaggccccguacaagcucgacgagcuggugcgcuuccggguccccuacuacgugggccccaugauaacgccugacgagcaggagaagaccagcggcaaguccuucgccuggauggugcgcaaggaggacgggcagaucaccccguggaacuucgagcagaaggucgaccggcaggagagcgccaacaaguucaucaagcgcaugaccauaaaggacacguaccuguuaggcgaggacgugcugcccgccaacagccugcuguaccagagguucgagguacucaacgaacugaauaacauccgcauaaaugggucccggaucagcaucgaccuaaagcagcagaucuucaacgaucucuucgaggagaagaagaccgugaccgagaagucccugacaagcuaccugaagcagaaucuccaccucccaacuguggagaucaagggccuggcggaccccaccaaguuuaacuccagccuggccuccuacuaccaccucaagagccugcacgucuucgacaaggagcuggcagacccgcaguaucagaaggacuucgaaaagaucaucgaguacuccagcaucuucgaggacaagaagauauaccaggacaagcugcacgccgaguucaaguggcucacccccgagcaguuuaaggccaucuccaccuggcgccuccagggguggggccgguuaagcugccgccugcucguggagcugcacgacacgaacggccagaacaucauggagcagcugugggacucccagaagaacuucaugcagaucgugaccgagcccgacuuuaaggaugcgaucgccaaggagaaccagaacgucacccaggugaacgggguggaggagauccuugccgacgccuacaccagccccgcgaacaagaaggccauccggcaggucgugaagguggucgccgacguggugaaggccgccggcgggaagaagccggcgcaguucgccaucgaguucacccgcgaccccgacaaaaauccccaacucucccacauucggggcacgaagcugcucaaggccuaccaggagaccgccggggaguuggucgaccagaagcugaccgacagccucaaggaagccaugaccucccgcaagcuguugaaggacaaguacuuccucuacuucaugcagacgggccgggacgcguacaccggcaagaagaucaacaucgacgaggugaccaccaacuaccagaucgaucacauccugccccagagcuucaucaaggacgauuccuucgacaaccgcgugcugacggccaccccgcucaacgccgagaaguccgacgacguacccuacaagagguucgccaauaacuacgugagcgaccugaaaaugaccgugggggagauguggaagcacuggcaaaaggccggaaucaucaacaagcacaagcuggggaaccuacugcuggaccccgauagacucaacaaguuccagaaguccggcuucaucaaccgccaacuggucgagaccucccaaauugugaagcugguguccgucauccuccagaacaaguacccggacgcggagauuaucacggugaaggccggggacaacagcgcccugcggcagcgcuuaaaccucuacaaguccagagacgugaacgauuaucaccacgccaucgacgcguaccugagcaucaucugcggcaacuuccuguaccaggucuaccccaaguaucgccccuauuucguauacggcaaguacaagaaguucucccaggacccggaccuccagaaggaccugauuaagcacuucaagggguucaccuucauguggccguugcuccagaaggacaacagcgagcggaaggcccccgaggagaucaaggagaacaacucagagcgaaucguguucuacaagcaccccgacaucuucgacaaacuucggaaggccuacaacuacaaguacaugcuggucucacgcgagaccaccacggaauccagcuccauguucaagaugaccaucuuccccagaggcgagcgcgacagaaagaagacccgcaagcucaucccgaaggggaacggccuggaccccaagaucuacggcggguacagcggcaacaccgaugcguacauggugaucgugaagaucgacaaggccaaggaguccaucuacaaggucaucggagugcccaugcgggcacugacgcgccucaaccaggccaagaagcaggggaacuaccaggaggagcugcaccagguguuagagccccagaucaugcucgauaagaacgggaagccgaagcggggcgucaaggguuuccgcgugaucaaggaucacgugcccuucaagcaagucgugcuggacggggacaagaaguucaugcuguauagcgcccaguacaagaccaacgccaagcagcucgcccugucccaggagaccaugcggaucgugaccgacaaccugaagaagggcgaggaccaggacaagcucuuggucaaggcguaugacgagauccugcagaagguggacugcuaccuaagccuguucgacacgagcaacuuccgcaacgggcugcaccucggccggaacaaauucaucgaccuggaggugaacgacaagaagaucaccuuguccaacauccucaacgggcugcacgacaacaugguacugggcaaccugaagaacaucggcaucgggacgccccugggccagaugcaggagaaguccgggaucacccugagccccgaggccgugcucaucuuccagagcccgaccggccuguucgagaagcgcgugaagaucgccgaccuguga

SEQ ID NO: 7900 - RNA, 4188 nt, Artificial Sequence
  Cas9 variant
augaagaaggagaucaaggacuacuuccuaggccucgacguggggaccggcagcgucgggugggccgugaccgacacggacuacaagcugcuaaaggccaaccgcaaggaccucuggggcaugcggugcuucgagaccgcggagaccgccgaggugcgccggcugcaccgcggggcccggcgccggaucgaacgccggaaaaagcgcaucaagcugcuccaggagcuguucucccaggagaucgccaagaucgacgagggcuucuuccagcggaugaaggagagccccuucuacgccgaggacaagaccauccugcaggagaacgcccucuucaacgacaaggacuucacggacaaaacguaccacaaggcguaccccaccaucaaccaccuaaucaaggccuggaucgagaacaaggugaagcccgacccccgccugcucuaccuggccugccacaacaucauuaagaagcggggccacuuccuguucgagggggacuucgacuccgaaaaccaguucgacaccagcauccaggcccucuucgaguaccugcgcgaggacauggagguggacaucgacgcggacucccagaaggugaaggagauccugaaggacagcucccucaagaacuccgagaagcagucccggcugaacaagauccugggccugaagcccagcgacaagcagaagaaggccaucacgaaccugaucuccgggaacaagaucaacuucgccgaccuguacgacaacccggaccucaaggacgccgagaaaaacagcaucuccuucagcaaggacgacuucgacgcgcuguccgacgaccuggccucuauccucggcgacuccuucgagcugcugcucaaggccaaggccgucuacaacugcagcgugcugaguaaggugaucggggacgagcaguaccugagcuucgccaaggucaagauauacgagaagcacaagaccgaccucaccaagcugaaggcggugaucaagaagcacuuccccaacaacuacaagaagguguucggcuacaaccaggacaacgagagcaagaacaauuacuccgguuacgucggagugugcaagaccaagaauaagaagcuggugaucaacaacagcgucaaccaggaggacuucuacaaguuccucaagcccauccuguccgccaagagcgagaucaaggaggugaacgacauccuggccgagaucgagacgggcaacuuccuccccaagcagaucuccaagagcaacgccgagauuccguaccagcugcgcaagauggagcuggaaaagauccucuccaacgccgagaagcacuucagcuuccugaagcagaaggacgagaaggggcugucccacagcgagaagaucaucaugcuccugaccuucaagauccccuacuacaucggccccauuaacgacaaccacaagaaguccuuccccgaccggugcuggguggugaagaaggagaaguccccgagcggcaagaccacucccuggaacuucuucgaccacaucgacaaggagaagacggcggaggaguucaucaccagccgcaccaacuucugcaccuaccugaucggggaauccguucucccaaagaacagccugcuguauuccgaguacacggugcugaacgagauaaacaaccuccagauaaucaucgacgguaagaacaucugcgacaccaagcugaagcagaagaucuacgaggaucuguucaagaaguacaagaagaucacccaaaagcagaucagcaccuucaucaagcacgaggggaucugcaacaagacggacgaggugauaauccucggcaucgacaaggagugcaccuccagccucaagagcuacaucgagcugaagaacaucuucgggaagcaggucgacgagaucuccaccaagaacaugcucgaggagaucauccgaugggccaccaucuacgacgagggcgagggcaaaacgauccugaagaccaagaucaaggccgaguacgggaaguacugcagcgacgagcagaucaagaagauccugaaccucaaguucuccggcuggggucgccugagcagaaaguuccuggagaccgugaccuccgaaaugcccggcuucagcgagccggugaacaucaucacggccaugcgcgagacccagaacaaccucauggagcugcugucgagcgaguucaaguucaccgagaacaucaagaagaucaacuccggguucgaggacgccgagaagcaauucagcuacgacggacucgugaagccccuguuccugagucccagcgucaaaaagaugcucuggcagacccugaagcuggugaaggagaucucccacaucacgcaggcgcccccgaaaaagaucuucaucgagauggccaagggcgccgagcucgagcccgcccgcaccaagacccggcugaagauccugcaggaccucuacagcuccugcaagaacgacgcggacgccuucagcuccgagauccaguaccugagcgggaagaucgagaacgaggacaaccugcgcuugagaagcgacaagcuguaccuguacuacacccagcucggcaagugcauguacugcgggaagcccaucgagaucggccacguguucgacaccuccaacuacgacaucgaccacaucuacccccagagcaagaucaaggacgacuccaucagcaaccgcguccuggugugcuccucaugcaacaagaacaaggaggacaaguacccgcugaaguccgagauccagagcaagcagcggggguucuggaacuuccuccagcgcaacaacuucaucucccuggagaagcugaaccggcucacgcgcaccacccccaucagcgaugacgagaccgccaaguucaucgcccggcagcugguggagacgcgccaggccaccaaggucgcggccaagguccuggagaagauguuccccgagaccaagaucguguacuccaaggccgagaccgucagcauguuccgaaacaaguucgacaucaucaagugccgcgagaucaacgacuuccaccacgcccacgacgccuaccucaacaucguagugggcaacgucuacaacacgaaguucaccaacaaucccuggaacuucaucaaggagaagcgggacaacccgaagaucgcggacaccuacaacuacuacaagguguucgauuacgacgugaagcgcaacaacaucaccgccugggagaaaggcaagacgaucaucaccgucaaggauaugcugaagcggaacaccccaaucuacacccgccaggccgccugcaaaaagggcgggcuguucgaccagacgaucaugaagaaggggcucggucagcacccccugaaaaaggagggcccguucuccaacaucagcaaguaugggggcuacaacaagguguccgccgcguacuacacccugaucgaguacgaggagaaggggaacaagauccggagccucgagaccaucccccuguaccuggugaaggacauccagaaggaccaggacguccucaaguccuaccugaccgaccugcucggcaagaaagaguucaagauccugguucccaagaucaagaucaacagccugcucaagaucaacggauuccccugccacaucacaggcaagaccaacgacuccuuccugcugcgcccggccgugcaguucugcugcagcaacgacgagguccucuacuucaagaagaucauccgguucagcgagauacgcucccagcgugagaaaaucggcaagaccaucagccccuacgaggaccuguccuuccggagcuacaucaaggagaaccugugcaagaagaccaagaacgacgagaucggggagaaggaguucuacgaccuccugcagaagaagaacuuggagaucuacgacaugcugcugacgaagcacaaggacaccaucuacaagaagcgcccgaacuccgccaccaucgacauccuggugaagggcaaagagaaguucaagagccucaucaucgagaaccaguucgaggugauccuugagauccugaagcuguucuccgccacccggaacgucucagagcugcagcacaucgggggcuccaaguacagcgggguggcgaagaucgguaacaagaucuccagccuggacaacuguauccucauauaccaguccaucacgggcauuuuugaaaagcgcaucgaccugcugaagguguga

SEQ ID NO: 7901 - RNA, 4188 nt, Artificial Sequence; identical to SEQ ID NO: 2101
  Cas9 variant

SEQ ID NO: 7902 - RNA, 4188 nt, Artificial Sequence; identical to SEQ ID NO: 2102
  Cas9 variant

SEQ ID NO: 7903 - RNA, 4188 nt, Artificial Sequence; identical to SEQ ID NO: 2103
  Cas9 variant

SEQ ID NO: 7904 - RNA, 4188 nt, Artificial Sequence
  Cas9 variant
augaacgcaaaccgcgagauggccuacuacaucggcaucgacauggggaccggcagcguggggauggcgaucaccgacgaaaacuauaauuugcucaaggucaagggccaggauuacugguucgugcgggaguucgagacggccaacacccagaucaagcgccgaaugcaccgcaucagcaagcggcgccugcggcgccaccaagugcgggucgcccugauccgcagcuacuucgcagaggagauccucaagaacgacccccuguucuucauccggcaggacaacuccaucuacuaccuugaggacaaggacagcgugcucaagaccaaggacugccuguucgccgauuacaacuaucacgacaagaacuacuacaaggacuacccgaccauuuuccaucuccgccaggcguucaucaaggacacggugaaggacgaugagaaccacacccgguacgccaggcuccuguaccuggccaucaucaacauguucgagcaccgggggcacuuccucuuaaauuccgucagcgaggacauuaacaaggagaugguuaaggacgccggcgagggcuucacccuguaccuccaggaacggaucaaggagaucaagcccguguccuacagcgacauccuggacguccugguggagaagaacaucucccggagcgagaagaaggagcgcaucguggagcuguucgggaucaagaaguccugcaagaacggcauggagaucaucaagugccugugcgggcuggaggcgaacgucgccaucauguucaaccucgacgacaucgaaaacaagcugaccaucguggugagcaaggacgauuaugaggacaaguuagccgagguccagccccucguagacgaggaguccuucgagcugcugagccggaucaagcagcuauacgacuacucccagcugcagucgauccugaagggcuacaaggagaaggaggacggggaggacaaauaccucuccgacgugcgcguugagcuguacgagaagcacaaggccgaccugaagcuccugaagaagguguacaagcgugacuuggacaagaaaggcaagaucugcgagggcaaaaacauccagcgcaguuccaaguacaacuucauguuccgcagcgggaaggacggcacguacagcgccuacaccaacucccucaacagcuucugcuccaagaccaucgagaacaaguaccggcgcaacaugaagaaucgggaccgcgcgagccuguacgacaccaucaagaaggaccuauccgguaucgagaacgacgacgugaagaagauccuccgggacauagagacggagaaguuccugcccaagcagaucaccggcgagaacggcgucaucccgaaccagauccaugcaaaggaacugaaggccauccucaagaacgcggagaaacaccuccccuuccugaccgagaaggaugacagcgggcugaccguguccgagcgcaucaucagccuguuucgguacugcauccccuacuacaucgggccugucgggaaggacucccgcacgggcugggccagcaucaaggaggaggggcaaaucuucccguggaacaucgagcagaagaucgacgucgacaagaccuccgaggaguucaucacccggcugaucaagaccugcacguaccucagcaacgaaaagguuguccccaagcagucccugguguacgagcgauacugcguguuaaacgagaucaacaacauaaagauccggggcaaacgcaucgacccccagcugaagcaagagaucuucaaggaacucuauaucggcagcaagugcgggaagaaggugacccggaagaaccucugccaguaccuggugaauaagggcgcgauagaggaggacuccgagaucagugggaucgacaaggaccugaacacauauauguccagcuacggcaagauguaccagaucuucggggacaagaucaagcgcgacgacaucaaggagguggccgaggagaucaucuacuacggcaccauuuacggcggggccaaggagauguucaagaaaaagaucgagcaguacgucuccgaggacauccuggacgaggcccagaugaaccggauacugggcuucaaguucaaggacugggcccgccucagcaaaaaguuccuguacuuagagggguacgacaaggggaaccagaaccagcucacgacgcugaugcaggcgcugugggacuacaaucucaacaccauggagcugaugaacagccccauguucaccuuuaaggagacguuagagaagcagaaaaacaagauggagaaggugcucugcgacuucgaguacgaggaccuggacgaauacuacuucuccgccccggugaagcggauggucuggcagaccaucgccugccugaaagagguggugcaaaucauggggcacaaucccaagcgcaucuucaucgagaugccucgggcagacgaggaaaagggagagcagggcagaaaggccagccguaagaaccgguugcugucccuguacgaggagaucgaggacgaacgccccuggaagaaggagaucgagaacgcggccgagagcgggcggcucaauucgaagcgcauguacuuauacuaccugcagaugggcaaggacgccuacaccggggaggacaucgacaucgaggaccucuucgacaacagcaaguacgacaucgaccacaucuacccgcgaucccugaccgacgacaacagccuggagaacaaccucguccugguguccgccacgaucaaccaggacgugaagaagaacgacuaccccauccccuaugauaagauccgcggcaacagcaagguccgggagcuguggcgcuuucuccacgagaagaaguuuaugaacgacgagaaguacaaccgacugauguccgacgugccacugacccaagagcagcuugcgggcuacaucgcccgccaacugguggaaaccgcccaggggaccaagggcaucgccgacaucaucaagagcguuauuccggacgccgacaucaucuacucuaaggccaagaacgugagcgacuuccggaagcgcuacgggaugcugaaaucccggcucacgaacgacuuccaccacgccaaggacgccuaccugaacguggucgugggcaacguguacuucacaaaguucacccagaaucccagaaaguacaucaaagacgagaacgacaucgaaaacaagaaguacaacuauaaccugagcaagauguacgacaaagacgucauccggaacgggaagguggccuggaucgcccagaacggcaagaaggcgggcaccauccagaccauaaagaaggugauggacagaaauacgcccaucaucacccggcaggccuuugagcagcgcggggaauuauacgaccugcagcccaucuccaagcacaaggccaagaaggagaacuacgucccgaucaaggccaccaacgagaaaaugaaggacgugacuaaguacggcggguucaccagccugaacccagccuacuucguguuugucgaguacggcagcgcgaagaagagacagcgcuguuucgccgugguacacuccuacugggccucguccaucaagaauaacgaggaccucguaacccaccugaaggaccggggguacgagaaccccaucgugaucgccgacaagaucaagaagaacagccuaaucaaguacaacggcuacuuccucuacaucgugggcauggacgcgcgcaagcaggucgaguucuccaacgccaccagcaugugccugaacaacaacuucauccaguacauccagaagaucgagaaggccaacacccugaucgccgaggccaaaaagcgccggcccuacaucgacgagucaaucacggcggagcgcaacaucgcccucuacaacgagcugaagaagaagcaccuggacagcaucuuuaagaaccacccgaaggggaucggcuccgugcucgagagcggggagggcgccuucgugcagcugucccuggagcagcagaucgggauccucuacucgauaauccaauucuccagcuucaagaagggcaccuucucccuaacccugaucggcgggcccaaggaagucggccggauccgcaucagcgggaauaugccgaaggcccgggagcucaaguugauccacuacucgaucaccggcauguauaaaaaggagaucaaccugcucgacuga

SEQ ID NO: 7905 - RNA, 4188 nt, Artificial Sequence; identical to SEQ ID NO: 2105
  Cas9 variant

SEQ ID NO: 7906 - RNA, 4188 nt, Artificial Sequence
  Cas9 variant
augaaccuccgcaacaccaccgacgaauauaauauagggcuagacaugggcacaaacuccgucggaugggcagucaccgacaaagucggagccaucgcgcacuucaaaggaaugccgacacuagggagcagacuguucgacgccgcccaaacugccgccgaagcacgugcucacagaggacaaagacgacgauacgugagacggagguggaggcucgaccuccugcaaucacucuuccaagacgaaauagacaaaguagacucagaguucuucauacguuuacgucaaucgagacuacacgucgaagacagagaagacggucaugccgacuacaaauggccaaucuucaacgacuccgauuuuacagaaguggauuacuacaaacgcuuccccaccauuuaccaucuacgaaaguggcucaucgaaacggaccagaaggcagauauacgcuuaaucuaccuagccguccauaacauagucaaacaccgcgguaacuuccuccgcgaaaacaacaaaaaccucucaagccguaaugccgaccccgcugaagccguaggccaccuucggcucgcgcucaacaacuggugucuggaaagaggauacgaaugcgcauggaaaaguggugggaacgacaacgccauccugaacgugcuuaucgauggggaaaagagacgauccgaccaaguacgcgagauagcaaaacugacuggcauagacugcggagaugcaaagcaaagccgacaauguaacgaagccauagcuaaggcuauaguagggcucaaggcagaaaugaagaacauauucggagaauuuccggcggaaaagacacugauauaccucucaucggacgacgacguugaaguagugcgagacgccugcccagacgacagcgucgagcuauuccaagcucugugcgagcucuaugccgccuacauucuucagggccuacuaucguacgcacccggucaaaccauauccguaaacauggucaagaaauacgaucgauacggcgaagaccuccaccuacucaaagaacuaacacggacguacgcaagcaagcgauacgacgcguucuuucgcggcgaaacuuacgaggggucgagcgacuacgucgucgacaaggcucagggcuauacacgauacaaccuaggaacgacccaacucagcuacgaugacuuccagaaggcaguaaaggagcuauucaaaggaaccgacgcacuccaagaugaacgguaccaaggaaugauggucgccuucggugaacaaagauuccugcgccgucuaaaaacaagcgauaacggcucaauuuauuaucaauuacaccucgaagaacuacacgcaauccuggagaaccagggaaaacacuacccguuccuucucgccgaagaggauaagauagaaucccucgugagcuuccggaucccauacuacguagggccccuaaccagagaaaacgccgcaguugggcaugacgggaaagagcgauucgccuggucgagccgccgugacggaauggaacacgccguaaucacccccuggaauugggaagaaauaauagacagagacaaaucagcugaagacuucaucauccggaugacgggagacugcaccuaccuacaaggagaacccguccuaccaaaauguagccuccuguacgaagaauuuugcgcacugaacgagcugaauggagcccacuggacgaucgacgaagacgacgagcgacgcuucgaugccgcacaacgcgaacgcaucaugugcgaucuauuccgauccacccguaaaguaacauacaagaaaguguccgacuggcucgaacgcgaagacagcuucgucggagccagaguacacggcggacaaggagagcauggauucgagucccagcuuggcagcuauaucuucuucugcaaagacgucuucaaaacggacagccucgacgaggcggacuacccaaugaucgagcagauaauacugugguccacacuauuugaagaccgcgacauucuccgccgaaaaauagaagaagccuacggcgaucgacucacaaccgaacaaauaaagguaauuugcaaaaagcgauucgcaggcuggggcaggcuaagcaagaaacuccucaccggcaucaaaguagacacggauaccgggcgcaaaaguaucaucgacguccuccgggaggguaauccaaacgacggacaaagaagcagaacaauggucuucauggaaguucucagggacgaggggcuaggguuccagaaagccgucgacgacuuuaaucgcgauuacuucucagaacacaacaacggccuuauggacgugaacgaccucccagggucccccgcgauccgacgcucuaucaaucaagcagucagaauaguggacgaaauugugagcauagcaaagaaagaaccggcuaacaucuucaucgaagugacacgagaagaggaugacccccgaaagaaagggaaacgcacaaaaaggcgcuacgacgcaaucaaauccgcgcuagaaguguucaagaaagacgacccacaacuuuggaaagaacuaaccaagaaagacucaaacaacauggacgaacggcugucgcucuacuucaugcaaaggggaaaauguauguacucagggcgaccgaucaaaauagaggaacuacacaccggaaaauacgaagucgaccacauuaucccaagaagcuauauaaaagacgacucccucgagaacaaaguacucgucuaucgcgaggaaaaccagcacaaaaccgacacacugcuaauagacagcucaaucagacgcaaaaugggcaaauacuggcgcaugcuacacaacgccaaacugaucggcgauaagaaauuucgcaaucucuucagagaccacaucgacgauaaaacaaugaaagguuucgucgcccgccagaucgucgagacaagccaaaugguaaaauuaguccagacucuccuugaggcccgguacccaggcgccagaauaguaccagugaaagcgaacaucucacacgaccuccgcgacgcagccggacucgucaaaugccgcgaagccaacgacuuccaccacgcccacgacgcauuucucgccugccgagugggccuauuuauacaaaaacgacaccccuccguuuacgacaaccccauaggacuggcgcacaucaugcgcgacuacgcccgagcccaggcccgggaauacaagaaaucacacuaccucgcucacacaaaaggauucaucgucaacucguucuuauccucaggauucgacaaggaaacgggggaaguauuuaaagacgacugggacgccgaggccgaagucgaagguauacgccggguacugaacuacagacagugcuucaucucgcgaaugccaguagaagcaacuggcacauucugggaccagacgaucuacagcccgaaaugcgggaaaaagcucacucuaccacucaaaagaggacuagaucccgacagauacggcuccuacucccgugaacaauucgcuuauuucuucauauaugaggcacgcgaccugaaacacgagcggcacauccuccaguucgcccaagucccaguccgcgucgccgcccacaucgcaaaagaccccagccaacuagagucauaugccgucaaacuugccggacaagcaaaccucgccuuuguacgcauagugcgccggcgaauccucaagaaacaacuccucgagcucaacggggauaggcuaauaaucacaggaguccgagaagucagaaacgcaaccgaguucgcauucucccuagacgaagaaacccucauagaacgcugcguacaaaucgcgaagguaggaucgcuaaucggcgucguuaacgacgaggacgaggaacaacuaucagccgacuuaaacgaacucuucuccagccucgucaagagaggcccuaaacuauguaauaggcucuacgcacaacucaaacucgacaaauaccuaagcaaauucgacgaauuaacccuaaccgacaaggccaaagucguccuccaacuaauagcgaucaccaacggaucuaucaacauggcggaccucagcgcucugggcagcuccaaguacgcgggaugcaugcaagucagcuacuucaagcaacuaaacgcuccuaucggugaaguaaacaucaucgaccagagcgucaccggaauguucgaaagacgcacgcacaucggacuguga

SEQ ID NO: 7907 - RNA, 4188 nt, Artificial Sequence
  Cas9 variant
augaaggagaucaaggacuacaucaucgggcuggacaucgggaccaacagcuguggcuauguggucaccgacaagcagaacaauauccucaagcugaaggggaagacggccaucggcgcacgccuguucaaggaagggcaggcggcggccgaccggcgcuccuuccggaccacccgccggcgccucgcccggcgccacuggcggcuuggccugcucgaggagaucuucgaccccgagauggagaagaucgacccgaacuucuuccgccggcugaaggagagcgacuacucccccaaggacagccgcaagcaguucaacgccaucguguucaaguccaucaaggcggacaagcgguucuacaagaaguaccccaccaucuaccaccuccgcaaugcccucaugcacgacaaccagaagcacgaccugcgggagaucuucauggccgugcaccauaucgucaaguaccgcggcaacuuccugcgggaggacagcgugaacgccuucaaggcggcaaaguucuccuuacgcggggaggacggcaucggacccguggacaagcugaacgaccuucucaaggagaucuacagcgaguacuccccggagcuggccacgaacaaccugagcaagaucgaggacaucaucaaggacaagaaccucuacaagcaggacaaguugaagcaggucgccacacugcucaucaaggaggccgacuccaaggacaaggcgaagcugaacaaggacaucgccaagcaggucgccaacagcuucaugggcuacauguuucggcuggacaccuuguucucccugaccgacguggacgugaaggacuacaagcugaaguucagcgacgccaacaucgacgagucccucgacgaccugacgagccugcucaccgacgcccagaucgaguucgugcuggagcugcaguccauauauaauaccauugugcucaacgagaucguccccgacgggaugagccuguccgagagcaugaucaagaaguacgacgaccacaaggaagaccugaagaucuucaaggaguacaucgacagccucuccgaccagaagaaggcgaagaagcugcugagcgcauacaaccucuacgugaacuaccgcaaguccgaccugguggaggccaagaaccuguucaagaacaagaaggucggcgacaagaacuucgccgacgugaucagcaacuucgagguguucggcaaguucgucuccgauaaccucgacgacagcgagcuggccaacaagaucaaggcgcggcuggaccucggggaguuccuacccaagcagcgcaccaaccagaacggcgugauccccuaccagcugcaccagguggagcucacgcagauccuggagaagcaggggaaguacuacccguuccugaucacccccaaccccgucgagucccaccgcaacaacgcccccuacgagaucagcgagcuggugucauuccggguaccguacuacgucggcccccucaucgacaaccagagcaucaaggacaagcagaacaagaacaaauucgccuggauggugcgccagaaacagggccagaucacccccuggaaccuggaggagauggucgauaccacggaguccgccaaccaguucaucaagcggaugacccgcaaggacaccuaccugcucgccgaggacguccugcccaagagcucccugguguaccagaaguucaugauccucgacgagcugaaccggaucaagauugacgggaagaagcugaccagcgagcucaaacacgacaucuucgagaagcuguucaagaagcagaaguccaucaaccuggacaaccucaagaacuaccugcuggucgagggcaacaucccggggcucaucgagggucuaagcgacgggaucaacuucaacaacuccuucagcacguacaucgacuaccgcaacaucuucggcgacgagaucgacaaccccaacaagcaggcggacuucgagaagaugaucgagugguccaccguguucgaggaccggaagaucuucaagcgcaagcugaaggagaucaccuggcucaccagcgagcagaucaagcaggucagcuccaagcgguauagcggcugggggcgccuguccaagaagcugcucacgcaaaucaccgacgagaacggcgugaacauccugcagcggcuguggaacgagcccgagacccucaccgaggugcuggccaaccccgugaucaagcgcaagaucgucgaggccaacaguagcuucacgaaggccaaggacaugaaggacauccugguggaggcguacaccagcccgcagaacaagaaggccauccgccaggugaugcgggucguggacgauaucaucgccgccgcccacgggaagaagcccucccagaucgcgauagaguucgcgcgggaggaccaggacaacccccagaugaccaagagccgcaaggcccagcucgaccagaucuacgccaagaucuccgacgaguuccuggacgacgccgucaagaacgagcugaagaacaugaaggacaacaagccccucgcgaaggacaaggucuuccuguacuucaagcagaugggccgcgacgccuacagcggcgagaagcugucccucgacaaccugcaggacuacgacaucgaccacaucuacccgcagagcuuuaucaaggacgacuccuucgacaaccgcgugcuggugcagcgggccuacaacaacggcaagagcgacaacguccccgugcuccuguucggcaacaagaucgccgccgggcugggcaucaccauccgccagauguggaagaaguggcucgagcuggggcugaucuccaagcguaaguucaacaaccucauaacggaccccgagaagaucagccggaacauggcguccggcuucgugaaccgccagcuggucgagaccagccaggugaucaaacugguggccaacauccuccaggccaagcugcccgacaccgagaucaucgaggucaaggccuccuacaacuccauccugcggaaggaguucaaccucuacaagucccgggaggugaacgacuaccaccacgcgaucgacgccuaccugaccaccaucguagggaacuaccuguaccagguuuacccgaagcuccggcccuacuucguguacggccaguucaagaaauucggcaaggccgagaaccaggaggacgaccccgugaaaaagaucaagaaauucaacuucaucuaccagcugaucugggggaaagacgacgccaucugcaucucccacacaaaccagcaagucuucagcaagaaggacaucaucgacaaguuaaccaccgccuacaacuucaaguacaugaacaucagccacgcgguguacacgcgcaacaacaacauguucaagcagacgcuguucccgaucauagagcggaccaccgccaagaccaagagccugauccccaagaagcuggaccgcccgacggacaucuacggcggguacuccaacaacaacgacgccuaccucgcccuggugaaggucgacaagaaacggggcagcgaguaccgcguggucggcauucccaugcgggccgcggccaugcugaaggccuccaagaacuaugacgaggaccuccgcaaggucaucgagccgauggugauguucgauaagaacgggaaggccaagcggggcaucgagggguuccgcgugcuggucggcaagaugcccuucaagcaggcugugcuggacgggaacaagaaguucaugcucaccggcaccguggacaccccuaacuugaagcagcucguccucagccagcagaacaugaaguacauccuggacuacaucgaggacguggacugccggaagcacaaauucggcgacaaggugcagaaccccgacaagugccugcucgaggucuuugacgagaucaucgagaucguggacaaguacuucgaacuguucgacucccgcgacuucagggagaagcugcgcaacagccgcaacaaguucaucaagcucgaggcguccaagaaggccgacacgauccuggccauccugaaaggguuacaggccaagagcacccgcgcgacuaucaaggagcugaacaucuccgauuucggccguaucaucaccagcuccaucagcccggaggcccagcugaucuaccagucccccacgggccucuucgagcgccgcgugaaggucaaggaccuauga

SEQ ID NO: 7908 - RNA, 4188 nt, Artificial Sequence; identical to SEQ ID NO: 2108
  Cas9 variant

SEQ ID NO: 7909 - RNA, 4188 nt, Artificial Sequence; identical to SEQ ID NO: 2109
  Cas9 variant

SEQ ID NO: 7910 - RNA, 4188 nt, Artificial Sequence; identical to SEQ ID NO: 2110
  Cas9 variant

SEQ ID NO: 7911 - RNA, 4188 nt, Artificial Sequence; identical to SEQ ID NO: 2111
  Cas9 variant

SEQ ID NO: 7912 - RNA, 4188 nt, Artificial Sequence; identical to SEQ ID NO: 2112
  Cas9 variant

SEQ ID NO: 7913 - RNA, 4188 nt, Artificial Sequence; identical to SEQ ID NO: 2113
  Cas9 variant

SEQ ID NO: 7914 - RNA, 4188 nt, Artificial Sequence; identical to SEQ ID NO: 2114
  Cas9 variant

SEQ ID NO: 7915 - RNA, 4191 nt, Artificial Sequence; identical to SEQ ID NO: 2115
  Cas9 variant

SEQ ID NO: 7916 - RNA, 4191 nt, Artificial Sequence
  Cas9 variant
auggcgaaccugcgaaacuacaaaggugacuacaacauaggacucgacaugggaacggggucugucgggugggcggucaccgauucggaaggcaaacuacuccacuucaagaagcaaccaaccuggggaucacggcuauuugacagcgcggagacggccgcaagcgcaaggaucccuaggggccaaagacgccgcuacgugaggagacgauggaggcuagaucugcugcagcaacuauuccaagacgaaguaucgaaagcagacccagaguucuucauccggcuccgacaaagccgcuuacugaaagaagaccgagaagaagggcaccgcgacuacaaccauccccucuucaacgacucggauuucacugaaacagauuacuacaaccgauuccccaccaucuaucacuuaaggaaauggcugauggagaccgaugaaaaggccgauauaaggcuaguauacuuggccgcccacaacauaguaaaacaccgagggaacuuccugcgccaagaaaauaccagccucagugccaagaacgcccgcccccuagacgcgcuccgcgaguucagauccgcccuaguagacuggugcgcagaacucggcuaugaaugcaaccccgacgaaagcggugagauaucaaacgagauucuuagcguacuagaggaagaacacguagcaaacagugacaaaaagaaaagaauaucaucacugaucggagucgccaugaacgagggggccaaggaaagcaaagccuguaacgacgcacucgcuggagcaauggucggacuaaaagccgaguucaagaacgucuucggcgaaaucucagcggaacaaacuuccauauaucugagcaacgacgaagccguagacgcacuccgugagggaauaccagacgaaggcuuggaacuauucggaaaacuaugcagcguauacagcgccuauguguuacagggccuacucagcuacgccccgggacaaaccaucagugugaacauggucgccaaguacgaaaaauacggcaacgaccucaaaacccuaaaagcccucgugugcgaauacgcgagagcggaauacgauucguucuucagaggggaauuuuacagggaccaagacggucaugaacuaaacauauacaacgccucaaaagcgcaaggauacaccagauauaaucugggaacuuccaaaaugagcuacgaggacuucgaaaaagccgucaagaaacucuucgcggggacggccgcagaagaggacgggcgcuaccuacagaugaugaaagaguucggagaacaacgauuucugcgacgccugaagacauccgacaauggcaguauauacuaucagcuccaccuagaggagcuaaccgcgauacuuagcaaucaaggaaaacacuaccccuuccuggucgaagacgcagagaaaauuaagucauuagugagcuuccgaaucccguacuacgucggaccccuaacagacaggaacgcccgaaaagacaaacacgggaaaaaucgauuugcgugguccgaacgaaaaagcggcauggaggacgcaguaauaaccccuuggaauugggacgaaguaauagacaggggaaagucugccgaggcguuuauaaccagaaugaccggaaugugcacauaccuucaaggagaagacgugcuaccaaaaugcagccuacucuacgaagaauuuugcguguuaaacgaacucaacggcucacgauggggaauggacggggacaaagaacaccgcuucgacgcugcggaucgagaggcgauaauagaagaacuauucaagaagaagaagacagugaaauacaaggacgucgccaacuggcuagagagagaagcaggucgcaugaacguacacguaaugggaggccagggggagacgggcuacgaaagcaaacugaguagcuacuacuucuuccgccgcgacauauucgacguggaagaacucgacagagcggacuaucccaugaucgaacagauaauacuuuggaacacacucuucgaagaccgaaggauacuuaaggagaagcucgaagacgcauacggaccgaaggggaauggccgucuugacgacgaccagaucaagaaaauaugucgcaaacgauucacggguuggggccgucuaucgaagaaauuccucacgggaauaaaagucgacacagacugcggccccagauccaucauggacguucucagagaaggcgaccccaacgcagguuuccgcggcaagacaauggugaugauggaaguccugcgugacgagaaccugggguuccaacaaaaagucgacgaguucaauaaaaauuacuuuggacaaaaaggaaaagcgcuugaagucaacgagcuccccggcagcccggccauacgucggagccuuaaccaggcaauacgcaucgucgacgaaaucgcaaaaaucgccgguaaggacccagaaagcaucuucauagagguaacacgcgacgacgaacuagacaaacggggcaaaaggacaaagcgacgcuacgacgcccuaaaagaagcccucacaguauucaaaaaggaagauccagagaucugggcagagcuccaggcaacaagcccaagcgaccuagacgagagacugacacucuacuucaugcaaagagggaagugccuuuauagcggagaaccgauagacauaaacaagcuaagcucaggggaguacgaagucgaucacauaaucccccgaagcuacauaaaagacgacucacuggagaauaaagcccucgugugcagaaaguacaaccaaagcaagacugacgcaaugcuccuggacccaagcaucagacgcaaaaugcgaagcuacugggauaugcuguuagacgccaagcuaauaggcccuaaaaagcaucggaaucugcugagggaccacauugacgagaaagcgaugaaaggauuugucgcaagacaauuaguagagacaagccaaucagugaaacucgccgggagccugcucucgguacgauauccaaacgcaaacauagucccaguaaaggcgucgaugucccacgaccuccgugaagccgccggauucgucaaaugcagagaagcaaacgacuuccaccacgcccacgacgccuaccucgcaugucgaaugggccucuucauacaaaugcgacacccuaaagucuacgagaauccaauagcaaugaccagagucaugcaaaaauacgcccaacagcagaguaaagaguucaaccgaaaccacagaguaccgggaacgagcggauucauagugaauagcuucauguccuccggauucgacaaggaaaccggagaaaucuuuaaagauacauggaaugccgaaaccgaaaucgaaggaauacgcaaagcgcuuaauuacaggcaauguuacauaucccgcaugcccauggaagacacaggggcguucuggaacgcaacagucuacucccccagggacccaaagauggggccaaagcucgcauuaccacugaagaagggccucgacccaaagaaguacggaggauucuccucccagcaauucgcauacuucuuuguguacgaagccagggacaaaaaggacaagcaggucuuucgcuuugcagaagucccaguauggcucgcaucccagauagaaucagacaagaucgcccucgagagauacgcgaccggacuagcugaggcggagaaacuaaaauuuguaaggauagaaagagcaaagauucuaaagaaacagcucaucgagauagacggcgaccgguuuauacuaaccggcaagaaagagaugcggaacggacgagagcuggcgcucucacaaaaagaaacgcucaaccucauaguggcgggagacgaaaacgccucacuggacgaccguggcaacgcgagcgacgccguauuugacgccaucgugcgccagggagacgagauuggacuaagacucuauaaacaauugaaaaucgccgagaucgcagaacgguaccgaaguguaggcgccgacgcgaaagucggggccgucaugagcuuacucagcuccauuaaugccagcagcaacauggucaaccucucgauggugggaggaagcaaguaugccggcaaucugcaaccgaacuacucaaaccuccuaagcgacccggaaacuaacuucgugauaaucgaucaaagcgucacgggaauguucgagagacgcacgcgaauaggauuguga

SEQ ID NO: 7917 - RNA, 4191 nt, Artificial Sequence
  Cas9 variant
augaccaagccauacagcauaggccuggacaucgggaccaacagcgugggcugggccgucauuacggacgacuacaaggugccagccaagaagaugaagguacucgguaacacuaaccgcgacuacaucaagaagaaucugcugggcgcgcuccuuuucgacgggggcgagaccgccgagggccggcgccugaagcggaccgcccgccggcgcuacacgcggcgcaagaaccggcuccgcuaccuccaggagaucuucgccgaagagaugaugcaggucgacgagagcuuuuuccagcggcuugacgacuccuuccucguggaggaggacaaacaggggagcaaguaccccaucuuuggcacccugaaggaggagaaggaguaccacaagaaguucaagaccaucuaucaccuccgcgaggagcucgccaacuccaaggagaaggcggaccugcggcugguuuaccucgcauuggcccacaugaucaaguuccgcgggcacuuccuguacgagggcgaucucaaggccgaaaacacugacguccaggcucucuucaaggacuuuguugaggaguacgacaagacgauagaagagagccaccuguccgagaucaccguggacgcgcucaguauacugaccgagaaggucuccaagaguucccggcuggaaaacuuaaucgcccacuaccccaccgagaagaaaaauacgcuguucgggaaucugaucgcccuaagccugggccuccaggccaacuucaaaaccaacuuccagcucucagaagacgcgaagcugcaguucagcaaggacaccuacgaggaggaccuggagggccuccuuggggaggugggcgaugaguacgccgaccuguucgucuccgcuaagaaccuuuacgacgccauccuguugagcgggauccucaccgucgacgacaacuccacgaaggccccacugagcgccuccauggugaagcgauauaaggagcacaaggaggagcuggcugccuucaagcgguucaucaaggagaaauuaccgaagaaguaugaggaaaucuuuaaggacgacacaaagaacggcuacgcgggguacgugggcgccgacaagaagcuccgcaagcggagcggcaagcuggcgaccgaggaggaguucuacaaauacgucaaggggauccucaacaagguagagggagccgacuacuuccuggacaagaucgaccgcgaggacuuccugcggaagcagcguaccuuugacaacgguagcaucccucaccaaauccaucuccaggagaugcacgcuauccugcggcggcagggcgagcacuaccccuuccugaaggagaaucaggacaagauagagaagauacugacauuccgcauccccuacuacguaggcccgcucgcccggaagggcucccgcuucgccugggcagaauacaaggccgaugaaaagaucacccccuggaacuucgacgacauccuggacaaggaaaagagugccgagaaguucaucacccggaugacccugaacgaccuuuaucugcccgaggagaagguccuacccaagcacagcccgcucuacgagacguucacuguguacaacgagcuuaccaagguaaaguacgucaacgagcagggcgaggcaaaguucuuugacaccaacaugaagcaggagaucuucgaccacguguuuaaggagaaccgcaaggugacgaaggacaaacugcucaacuaccugaacaaggaauuugaagaguuccggaucgucaaccugaccggcuuggacaaggagaacaaggcguucaacgccagccugggcaccuaccacgaccugcgcaaaauacucgacaaguccuuccuggacgacaaggugaacgagaagaucaucgaggacauaauccagacccugacguuauucgaggaccgugagaugauccgccaacggcugcagaaguacagcgacaucuucaccacccagcagcugaaggagcuagagcgccgacacuacacgggguggggccgccuaucguacaagcugaucaacggcauucggaacaaggagaacaagaagacgauccucgacuaccugauagaugacggcuacgcuaaccgcaacuucaugcaacugaucaacgacgacgcucucagcuucaaggaggagaucgcccgggcgcagaucaucggcgacguagacgacaucgccaacgugguccacgaccugcccgggucccccgccaucaagaagggcauccugcagagcgucaagaucguagacgagcucguuaaggucauggggcacaauccaaccaacaucaucaucgagauggcccgcgagaaccagaccaccgacaagggcagacgcaacucucagcagcggcuaaagcugcuccaggacagccugaaaaaccuggacaacccggugaauaucaagaacgucgagaaccagcagcuacagaacgaccgguuguuccuguacuacauccaaaacggcaaggacauguacaccggcgagacgcuugacaucaacaaccugucccaguacgacaucgaccacaucaucccccaggccuucaucaaggacaacagccuggacaaccgcgugcucacccgcuccgacaagaacaggggcaagagcgacgacgugccuuccauugaggugguccacgagaugaaguccuucuggagcaagcuguuaagcgucaagcucauuacccagcggaaauucgacaaccugaccaaggcggagcgcggcggccugacggagaacgacaaggccggcuucauaaagcgucaacuuguggagacacggcagauaacuaagcacgucgcccagguucuggacgcccgguucaacgccaagcacgacgagaacaagaaagugauccgggacguaaagaucaucaccuugaagucgaaccucgugucacaguuccggaaggacuucaaguucuacaaggugcgcgagaucaacgacuaucaccacgcgcacgaugccuaccugaacgccgucaucggaacggcccuucucaagaaguaccccaaacuggcgagcgaauuuguguacggcgaguucaagaaguacgacguucggaaguucaucgccaaauccgacaaggagaucgggaaggccaccgccaaguacuucuucuacagcaaccugaugaacuucuucaagaaggaggucaaguuugccgacggcacagugguggagcguccggacaucgagaccuccgaggacggggagaucgcguggaacaagcagacggacuucaagaucguccggaaggugcucuccuacccccaggugaauaucgucaagaaaaccgagguucagacccacggacuggaucgcggcaagccccgugggcuguucaacgcaaaccccuccccuaagcccaagcccgacuccuccgagaaccucgugggcauaaagcguaacuuggaccccaagaaguaugggggcuacgccgggaucagcaacuccuacgccgucuuaguaaaggccaucaucgagaagggagugaagaagaaggagacgauggugcucgaguuccaggggauuagcauccuggaccggauuacauuugaaaaggacaagcgcgcuuuucugcuugggaagggcuacaaggacaucaagaagauaaucgagcugccgaaauacucacuguucgagcucaaggacgggucucggaggaugcuagcauccaucuuauccaccaacaacaagcgcggcgagauucacaaggggaacgagcuguucgugccccaaaaguuuaccacgcugcuguaccacgccaaacggaucaacaaccccaucaacaaggaccacaucgaguacgugaagaagcaccgcgacgacuucaaggagcuccugaacuacguccuggaguuuaacgaaaaguauguaggcgccacgaagaacggcgagcggcucaaggaggccgucgcggauuucgacucaaagagcaacgaggagaucugcacgagcuuucuaggggccgucaacuccaagaacgccggucuguuugagcucacaagccuaggguccgccagcgacuucgaguuccucgggguaaagaucccgcgcuaccgggacuacacccccuccucucuccugaaggacuccauccugauccaccagagcaucacggggcucuacgaaacucguaucgaccugaguaaacugggcgaggacuga

SEQ ID NO: 7918 - RNA, 4191 nt, Artificial Sequence; identical to SEQ ID NO: 2118
  Cas9 variant

SEQ ID NO: 7919 - RNA, 4194 nt, Artificial Sequence; identical to SEQ ID NO: 2119
  Cas9 variant

SEQ ID NO: 7920 - RNA, 4194 nt, Artificial Sequence
  Cas9 variant
augaagaaggugcugggccucgaccuggggaccaauagcaucggcugggcccuggucaacgaggccaccaaggaggagaagaaggaggggaaaucauccgagaucaucaagcucggugugcgagugaacccccugacggucgacgagaaaaccaacuucgagaagggacggccgcuguccaccaacgcggaccggacccucaagcggagcgcccgcaggaaccugcagcgcuacaagcugcggcgccggaaccucaucgagauccugaucaagaacggcuucaucacgaaggacacgccccugaccgagaccgggaaggacaccacccaccagacacucaagcuacgcgccaaguccgccaaggagaagguggaccugaaggacuucgccaagauccuccugaccaucaacaagaagcggggguacaagagcuccaggaaggugaauagcgacgaggacggccuggcgaucgacgggauggcggucgccaagcaucuguacgagcagaacuuaacgcccggccaguacgugcucaaccuccugcagaaaaacaagaaguacgugccagacuucuaccgguccgaccugcaggaagaguucaagaacauauggaacaaccagaagaccuacuacuucgauauccucaccgacacccuguucgaggagcugaaggacaaaaacaagagucagacgugggccaucugcaagaaaccguucgacaucgcggggaucaagcagaucggcaaggcauccgacaagcgccucgagcgguacaaauggcgcaccgaaggccugacccagaagcugaaccucgaguaccuggccaucgcccugcaggagaucaacaaugacaucaacaagagcuccggguaccucggcgccaucucugaccgguccaaagagcuguucuucaacaaggagaccgucggggagaaccuguaccgccaguuagugaagacaccccacacuagccugcggaaccaaguauucuaccgccaggauuaccuggacgaguucgaaaccaucugggagacccaggcuaaguucuacccccaguuaacgcacacccugaaggaggagaucagagacgucaucaucuucuaccagcgcaaguugaagucccagaagucccucaucagcuucugccaguucgagagcugggagcagaccuacaucgagaaggagaccgguaaguccaagacgcgcaccgugggccggaaggugauacccaaguccagcccgcuguuucaggaguucaaaaucuggcagaaccugaacucccucgaguuccgcaacagcgacgagggcgagauuaucgaguucaucaagcuggacgaggacauccggcagaccguuuucgaggagcugaaccuccgcggcaaccugaagcccaacgacgugcugaagaucuuagggaacuauauuucccucggcaaggugagccaguggaaaugcaacuucgaggagaucgaggggaaccggaccaacgccgcccuguacaacguauaccagauaaucgccgagaacgagggcuacggcuucgacugggccaagaagacggcuuccgagaucaacaaggagcugaagaacaucuucccccaacucgggaucgacgccagcaucuuggacuucgacuucacccaggccaauuucgacaaacagaccuccuaccagcuguggcaccuccuguacagcgccgaggaggacuucaagaucuccgaggaggacaaggugcuguacggcaacagcuccgucagccucaagaagaagcugcaccagaaguacgguuuuaagcccgaguacaccaagcugcucaccaacaucucccugcagccggacuacggcaaccugagcgccaaggcgaucuguaacauccuccccuaccugaaggaaaauaacgucuacuccgaggccugcgacuugaccggguacaaccacagcaacuuccucaccgccgaggagcaggccaagcgcccccugaagccuauccuggagcugcugaaaaagaacucgcugagaaacccggugguggagaagauccucaaccagauggucaacguggucaaccaggugaucgagaccuacggcaagcccgacgagauccgcaucgagcugacccgggagcugaagaaguccgccaaggagcgggcgaacaugaccaagagcaucgccgacgccacccggagaaacgacgacuaccggaagaccaucaucaaggaguuuggcauccccaaccccaccaaaagcgacgugguccgcuaccggcucuggcaggagcuggccagccgcggguacaaggacaucuucacggacaccgagaucaaaccgcaggagcuauucuccaacaagaucgacaucgagcacaucauccccaaggcgcuccucuucgacgacagcuucuccaacaagacccuggcuuucaagaaggacaaucuuaagaaggccaaccguaccgcguacgacuucaucgccaacgauuaugcgcccaaccuggagaacuacaucgagcgcguggagagccugcacaaggaccgaaagaucacgagggccaagaggaacaagcuccugaugcuacaaucgaagcuccccgacggcuucauugagcgggaccugcgcaacagccaguacaucaccaaggaggccaagaagaugcuguacgaggugugccggaccgucguguccaccagcggguccaucaccgacaagcuccgcgaggacugggaccuuaucaacgugaugaaggagcucaacuucccgaaguacaaagcccucggccugaccgagaagauagagcgguacgacaucggcgccgagaagaugaaggaggucgagaucauagaagacuggaauaaacgcaacgaccaccggcaccacgcaaucgacgcccugaccguggccuucagcacccacucccacauccaguaccucaaccaccugaacgcccgacgggacgagggccacaagaaacaugccgcgaucaucgccaucgagagcacgaucaccgagaaggagggcaacaagaagcgccgguucauugcgccccugcccaacuuccgccugcaggcuaaggaacacauagaguccauccuggugagcuucaagaacaagaacaaggucgugaccaacaacaucaacaagaccaagcggaucaagaaggacaaguucaacacuaaggugcagcucacgccccgcgggcagcuccacaaggagaccaucuacggcaagaucaagcagccgcucgagaagcacaucaaauugaacaaguccuucaccuuagaacaggccaagcugaucaucgacaagcggcagcgcgagaagguccugaaccaccucgagaaguacgcccacaacagcgacaucgcguucaacagcaagacccugaagaagaacccccuucucaucuccgaugagccccugaaggaggugcugugcuucgaggagguguucaccaucagaaaggacaucagcuacgacaacuucaagaacgagaagcagcucgacaaggucaucgacgagaaggugaagcaagcgcugaaggagcgcaucaaccaguacaacggggauuuccgggaggccuucuccgacaucgaacgcaacccgaucuggcugaacaaggcgaagggcauuugcgugaagcgggccaccaucaagggcgucagcaacgccgagccccuccacacggccaagaaccacuuaggggaggagguucugacggagaacaaggagcagauccccguugacuacgucuccaccgggaacaaccaccacguggccaucuacgaggacgaggacgggaaccuccaggaaaagguggucagcuucuacgaagcggugauccgugugaacgagggccugcccaucaucgauaaggaguacaacaagucccugggguggaccuucaaguucaccaugaagcaaaaugagauguucgucuucccgagcgaagacuucaaccccacggagaucgaccuccuggaccagaagaacgcgucccugaucagccccaaccucuuccgcguccagaaguucacgaucaaggacuacuucuuccggcaccaccuggagaccaccguggagaacaacaacacgcugaagaacaccacuuggcgccgggagggccuuucgggcauauacgggaucaucaagauccgccugaaucaccugggcgagaucguccaagugggggaauacuga

SEQ ID NO: 7921 - RNA, 4194 nt, Artificial Sequence; identical to SEQ ID NO: 2121
  Cas9 variant

SEQ ID NO: 7922 - RNA, 4197 nt, Artificial Sequence
  Cas9 variant
auggagacccaggccagcaaccagcugaucuccagccaucucaagggcuaccccaucaaggacuacuucgucgggcuggacaucggcaccuccagcgucgggugggccgucacgaacaaggcuuacgagcugcucaaguuccgcucccacaagauguggggcagccggcuguucgacgagggggaguccgccguggcccgccggggcuuccgcagcaugcgccgacggcuggagcgccggaagcuccgccugaagcugcucgaggagcuguucgccgacgccauggcgcaggucgacccgaccuucuucaugcggcugcgcgaguccaaguaucauuacgaggacaagaccaccggccacagcuccaagcacauccucuucaucgacaagaacuacaacgaccaggacuacuucaaggaguaccccacgguguaccaccuccggagcgagcugaugaaguccgggaccgacgacauccgcaagcuguuccuggccgugcaccacauccugaaguaucggggcaauuuccucuacgagggggccacguucgacagcaacgccuccacccuggacgacgucaucaagcaggcgcuggagaacaucacauucaacugcuucgacugcaacagcgccaucuccagcaucggccagauccucauggaggccgggaagaccaaguccgacaaggccaaggccaucgagcaccugguggacaccuacaucgcgaccgacacgguggacaccagcagcaagacccagaaggaucaggucaaggaggacaaaaagcggcugaaggccuucgccaaccucgucuugggccugaacgccucccucaucgaccuguucggcagcguggaggagcuggaggaggaccucaagaagcugcagaucacaggggacacauacgacgacaagcgggacgagcuagccaaggcgugguccgacgagaucuacauuaucgacgacugcaagucaguauacgacgcgaucauccuccugaguaucaaggagcccggucugaccaucagcgaauccaaggugaaggccuucaacaagcacaaggacgaccucgccauccucaagagccugcugaaguccgaccgcagcaucuacaacaccauguucaagguggacgagaaggggcugcacaauuacguccacuacaucaagcagggccggaccgaggagacguccugcaaccgcgaggacuucuacaaguacaccaagaagaucguggagggccugagcgacuccaaggacaaggaguacauccucagccagaucgaguuacagauccugcucccccugcagcggaucaaggacaacggggugaucccguaccagcugcaccucgaggagcugaaggccauccuggcgaagugcggccccaaguuccccuuccugaacgaggucgccgacggguucucaguggccgagaaacucaucaagaugcuggaguuccgcauccccuacuacgugggcccgcugaacacccaccacaacgucgacaacgggggcuucgccugggcagugcgcaaggcgagcggucgggugacccccuggaacuucgacgauaagaucgaccgcgagaaguccgccgccgcauucaucaagaaccucacgaacaagugcaccuaccugcugggggaggacguccuccccaagagcucccugcuguacagcgaguucaugcuccugaacgagcugaacaacguucggauugacggcaagccccucgagaaggucgugaaggagcaccugaucgaggcgguguucaagcaggaccacaagaagaugaccaagaaccgcaucgagcaguuccugaaggacaacggguacaucagcgagacccacaaacacgagaucacgggccucgacggggagaucaagaacgaccuggccuccuaccgggacaugguccgcauccugggcgacggcuucgaccggagcauggccgaggagaucaucaccgacaucaccaucuucggggaguccaagaagaugcucagggagacccugcggaagaaguucgccagcugccuggacgacgaggccaucaagaagcucacgaagcugcgcuaccgggacuggggccgccugucccagaagcuccugaacgggaucgagggcugcgacaaggcgggggacggcaccccugagaccaucaucauccugaugcggaauuucagcuacaaccucauggagcugcugggcgacaaguucucguucauggagcgcauccaggagaucaacgccaagcucaccgaggggcagaucgugaacccccacgacaucaucgacgaccuggcccugagccccgccgugaagcgggccgucuggcaggcgcuccgcaucguggacgaggucgcccacaucaagaaggcccugcccgcccggaucuucgucgaggugacgcgcuccaacaagaacgagaagaagaagaaggacagccggcagaagcgucugagugaccucuacgccgcgaucaagaaggaugacgugcugcugaacggccucaacaacgagaucuucggggagcucaagagcucccuggccaaguacgacgacgccgcccugcgcagcaagaagcuguaccuguacuacacccagaugggccggugcgcguacaccggcgagaucaucgagcucucccugcugaacaccgacaacuacgacaucgaccacaucuacccgcgcagcuuaaccaaggacgacuccuuugacaaccugguccugugcaaacggacggccaaugcccaaaaguccgacgccuaccccaucagcgaggagauccagaagacccagaagcccuucuggaccuuccuuaagcagcaggggcugaucagcgagcgcaaguacgagcggcugacccgcaucacgccccucaccgccgacgaccuuagcggcuucaucgcgcggcagcugguggagaccaaccaguccgugaaggccgccaccacgcuccugcgccggcuguacccgggggucgacgugguguucgucaaggccgagaacgugaccgacuuccgccacgacaacaacuucaucaaggugcggagccucaaccaucaccaccacgccaaggacgcauaccugaacaucgucguuggcaacguauaccaugagagauucacccggaacuuccgcgccuucuucaagaagaacggggccaaccggaccuacaaccuggccaagauguucaacuacgacgucaacugcacgaacgccaaggacggcaaggcgugggacgugaagaccuccauggacaccgugaagaagaugauggacagcaacgacguccgcgugaccaagcggcuccuggagcagacgggcgcccuggccgacgccaccaucuacaaggcgaccguggccgggaaggccaaggacggcgccuauaucgggaugaagaccaaguccagcguguucgccgacguguccaaguacggcgggaugaccaagaucaaaaacgcguacagcauaaucgugcaguacaccggcaagaagggcgaggucaucaaggagaucgugccccucccaaucuacuugaccaaccgcaacacaacggaccaagaccugaucaauuacguggccuccaucaucccccaggccaaggauaucagcauuauuuacgggaagcucugcaucaaccagcuggucaaggugaacggcuucuacuacuaccucgggggcaagaccaacuccaaguucugcaucgacaacgccauccaggugaucgucagcaacgaguggaucccguaccugaaggugcuggagaaguucaacaacaugcggaaggacaacaaggaccugaaggccaacguggucuccacccgcgcucucgacaacaagcauaccaucgagguccggaucguggaagagaagaacaucgaguucuucgauuaccuggucuccaagcugaagaugcccaucuaccagaagaugaaggggaacaaggccgccgagcucuccgagaagggguacggccuguucaagaagaugagcuuagaggagcaguccauccaccucaucgaacugcugaaccuccuaacgaaccagaagaccaccuucgaggugaagccccuggggaucaccgccagccgcagcacggugggcuccaagaucagcaaccaggacgaguucaaggucaucaacgaguccauaaccgggcucuacagcaacgaggugaccaucguguga

SEQ ID NO: 7923 - RNA, 4197 nt, Artificial Sequence
  Cas9 variant
auggagaaguccuacagcaucggccuggacaucgggaccaacagcgugggcugguccgucaucaccgacgacuacaaggugcccgccaagaagaugagagugcucgggaacacggacaagaaguacaucaagaagaaccugcugggcgcccuccuguucgacagcggagagaccgcggaggccacccggcuaaagcgcaccgcccggcgccgguacacgcgucggaagaaccgccuccgguaccugcaggagaucuucgccaaggagauggccaaggucgacgaguccuucuuccagcgccuggacgagagcuuccucaccgacgacgacaagaccuucgacucccacccgaucuucggcaacaaggcggaggaggacgccuaccaccagaaguucccaaccauauaccaccuccggaagcaccuggccgacagccaggagaaggccgaccuccgccugaucuaccuggcgcucgcccauaugaucaaguuccggggccauuuccuguacgacaacuucaacgacgacaacuucgacuggcgcaacaucgacauccagaagcgguacgaggaguucaucgagacguacgacuccacccugggggagagcuaccucgccgauaucuccguggacgccgccuccaucuuagaggagaagguguccaagaccgagcgccuggagaaccuccugaaguacuaccccaccgagaagaagacgaccuucuucggcaaccugaucaagcucauccuggggcagcaggcgaaauucaaggccaucuuuaaccuggaggacgagauuagccuccaguucgccacccccaccuacgaugaggaccuggaggagcugcucggcaagaucgacaacggggacuccuauuccgagcuguucgucgccgcccagaaccuauacaacacgauccuccuggcguccuuccugaagacagacaacaaaagcgccaaggccccgcucuccaccagcaugaucgagcgguacgagaaccacaagaaggaccuggccaagcugaaagacuuugugaagaagaacugccccgaccaguaccacgacaucuuccgcgacaagagcaagaacggcuacgccggcuacaucgacaacggggugucccagaaugacuucuacaccuucaucggcaagugucucgaggagagccugaagaaggacaagggggcgcaguauuuccuggacaagaucgaccgggacgacuuccuacgcaagcagcggacguucgacaauggcgccuuccccuaccagauccaccuccaggagaugcacgccauccugcgccgucagggcgacuacuauccguuccucaaggagaaccaggacaagaucgagaagauccugaccuuccggaucccguacuacgucgggccccuggcccgcaaggacagucgguucgccugggcgaacuaccgcagcgacgaggccaucacccccuggaacuucgacgaggugguggacaaagagaaguccgccgagaaguucaucacccggaugacgcucaacgaccuguaccugcccgaggagaagguccugccgaagcacagccucaucuacgagaccuucaccguguacaacgagcugaccaacaucaaguacgugaacgaccagggcaacgccauccacuucgacuccgagcugaaggagaagaucuucaaccagcuguucaaggagaaccgcaaggucagcaagaagacgcugaucgacuuccugaacaacuccgaggggaucuacaccgacaagcucgugggcaucgacgaggaggugaaguaccugaacgcgagccuggggaccuaccacgaccucaagaagauccuggaguccuucauggacgacgagaucaacgagaagaucaucgaggacaucauccagacccugacgcuguucgaggacaucgagaugaagcggcagcgccugcagaaguacgacgacaucuucacccccaagcagcugaaggagcucgcccggcgcaacuacaccggcuggggccggcugucguacaagcugaucaacgggauccgcaacaaggagaacaacaagaccauccucgacuaccugaagaacggcaaccggaacuucaugcaguuaauaaacgacgaccgccucucguucaagcaaaucaucaucgacgcgcggaagaucgagaagcuggauaacauugaaagcgucguguauaaccugcccgggucccccgccaucaagaagggcauucuccagagcaucaagaucgucgacgagcuggucaaggugauggggcacaacccggacaacaucgugauagagauggcccgcgagaaccagacgaccaaccaaggcaagaaccggucccagcagcgccugaagcggcuccaagacagcauguccaacuucaaggacagcagcaucucccugaaggacgucgacaacagcgaccugcagaacgaccgccucuuccuguacuacauccagaacggcaaggacauguacaccggggaggagcuggacaucgaccaccucuccgacuacgauaucgaccacaucaucccgcagagcuucaucaaggacaacuccaucgacaacagggugcugaccucuuccgcgaagaaccggggcaagagcgacgacguccccgggcgcgacguggugcugaagaugaagcccuucuggaagaagcucuacgacgucaagcugaucuccaagcggaaguucgacaaccucaccaagagcgagcacggcgggcucacugagucugacaaagcaggguucaucaagcgccagcuuguggagacucggcagaucaccaaguacguggcccagauccuggacggccgcuucaacaccaagcgggacgacaacaacaaggucauccgcgacgugaaggugaucacgcucaaaagcucccuagucagccaguuccggaaggacuucggguucuacaaggugcgcgagaucaacgacuaccaccacgcccacgacgccuaccugaacgcgguggucggcaccgccauccucaagaaguacccgaaacuggccccagaguucguguacggggaguacaagaagugcgacgugcggaaguuaaucgccaaguccggcgacaagagcgagaucggcaaggccaccgcaaaguacuucuuuuacuccaaccucaugaacuuuuucaagcgcgucauccgguacagcaacgggaugaucguggugcgccccgucaucgaguacagcaaagacaccggcgagaucgccugggacaaggagaaggacuucaaaacggugugcaaggugcuguccugcccccaggucaacaucgugaagaaggucgagaagcagagucacgggcuggaccggggcaagccgaagggguucuacaacgccaaccccucccccaagcccaagaagggcagcaaggucaaccucguaccgaucaaggccaaccugaaccccaagaacuacggcggguacgcgggcaucuccaacagcuacgccgugcuggucgacgccaccaucgagaagggggccaagaagaagcuaacccgcauccaggaguuccagggcaucucgaucaucgaccgggagaaguacgagaagaacaagguggaguuccugaaggggcugggcuacaaggagaucuacagcaucaucacccuccccaaguacucccuguucgagcuggccgacggcagccgccggaugcucgcguccauccugagcacgaacaacaaacgcggggagauccacaagggcaacgagcuggugcucccggccaaauacauccccuuacuguaccacgccaaccggauccacaacaccuucgagaccgggcaccgcgaguacgucgagaagcacaucgccgaguucaaggagaucgccgagaucauccucgaguucaacaacaaguacgugaacgccaagaagaacuccagcaucaucgagaaggcccuggaguccuucgacagcuucucccuggacgagaucugcgacagcuucgugggcaagcucaagaagaacaacaccaagaagaacuccggguuguucgaacuggucagccucggcagcgccuccgacuucgaguuccuggagacgaaggugccccgcuaccgggacuacacccccagcucccugcucaacgccacccugauccaccagagcaucaccggccuguacgagacgcgcaucgaccucucaaagcugggggaggaguga

SEQ ID NO: 7924 - RNA, 4197 nt, Artificial Sequence
  Cas9 variant
auggagacccaggccagcaaucagcugaucuccagccaccucaaaggcuaucccaucaaggacuacuucguggggcuggacaucggcaccuccagcgucgggugggccgugacaaacaaggcguacgagcugcucaaguuccgcucccauaagauguggggcagccggcuguucgacgagggggaguccgccguggcccgacggggcuuccgaagcaugcggcgacggcuggagcgccggaagcucagacugaaauuguuggaggagcuguucgccgacgccauggcgcaagucgacccgaccuucuucaugcggcugcgcgaguccaaguaccacuacgaggauaaaaccaccggccacagcuccaagcauauccucuucaucgacaagaacuacacugaccaggacuacuacaaggccuaccccaccauuuaucauuuacgggccgaacucaugaaggacgggaccuacgacaucagaaagcuguuccuggccgugcaccacauccugaaauaccggggcaacuuccucuaugagggggcgagcuucgacucgaacgccagcacccuggacgacgugcugaagcaggcccucgagaacaucacguucaacuguuucgacuccagcgccgccaucggcuccaucgggcagauccugauggagaccggcaaaacuaagagcgacaaggcgaagacgaucgagcgccuggucgacacguacaucaucaccgaugaggugaacgccuccggcaagacccagaaggaccaagugaaggaggacaagaagcggcucaaggccuucgccaaccuuguacuggggcucaacgccagccugaucgaccuguucggcagcguggaggagcuugaggaggacuugaagaagcugcaaauuaccggggacacguacgacgacaagcgcgacgagcucgcgaaggccugguccgacgagaucuacaucaucgacgacugcaagagcguguacgacgccaucauccugcuguccaucaaggagcccggccucaccaucuccgaauccaaggucaaggcauucaacaagcacaaggacgaccuggccauccucaagagccugcugaaguccgaccggucgauuuacaacgcgauguucaagguggaugagaagggccugcacaacuaugugcacuacaucaagcaggggcgcaccgaggagaccuccugcaaccgggaggacuucuacaaguacacgaagaaggucguggagggccuccccgacagcaaggacaaggaguacauucuguccgagauugagcugcagacccuccugccguugcagagaauaaaggacaacggcgugaucccauaccagcuccaccuggaggagcugaaggucauccuggcaaagugcggccccaaguuccccuuucucaacgagguggccgauggguucucgguggccgaaaaguuaaucaaaaugcuagaguuccgcaucccguacuaugucggcccccucaacaccucccacaacguggacaauggcggguucgccugggcugugcggaaggccagcggccgcgucacccccuggaauuucgacgacaaaaucgaccgggaaaaguccgccgccgcguucaucaagaaccugacgaacaagugcaccuaucugcucggggaggacguacugcccaagagcucccugcucuacuccgaguucaugcugcugaacgaacucaacaacguucgcaucgacggcaagccgcuggagaccaaggugaaggcccaccugaucaaggccguguucaagcaggaccacaagaagaugaccaagaaccggaucgagcaguuccucaaggacaacaacuacauccccgagaagcacaagcccgagaucacggggcuggacggcgagauaaagaacgaccuggccuccuacagggacaugguccggauccucggcaacaauuucgaccugagcauggccgaggagaucauaaccgacaucaccaucuucggggagagcaagaagaugcugcgcgagacccuccguaaaaaguucgcauccugccuggacgacgaggccaucaagaagcugagcaagcuacgguaccgggacuggggccgccuguccaagaaacugcucaacgggaucgacggcugcgacaaggccggggacggcacgagcgugaccaucaucgaggccaugagggacuucuccuacaaccugauggagcugcucggggaccgcuuccuguucauggagcggauucaggagaucaacgacaaacuuacggaggggcagaucgugaacccccacgacaucaucgacgaccucgcccugagcccggcggucaagcgugccguguggcaggcccugcggaucguggacgagaucguccacauuaagaaggcccuccccgccaggaucuucguggaggugacccgguccaacaaggcggagaagaagaagaaggacucucgccagaagcgccuguccgaccuguacgccgcuaucaagaaggacgacgcccuccugagcggccugacgaacgaggaguucggcggccucaaguccgagcucgcgaaguacgacgacgccgcguuacggagcaagaagcucuaccuguacuacacccagaugggccgcugcgcguacaccggggaggucaucgacuugucccagcucaacaccgacaacuacgacaucgaccacaucuacccccggagccugaccaaagacgacuccuuugacaaccuggugcucugcaagcgcacggcuaacgcgcagaaguccgacaccuaccccaucucaaaggagauccagaaggcccaaaaggccuucuggaucuuccugaagcagcaaggccucauaagcgagcggaaguacgagcgccucacccggaucaccccgcugacggccgacgaccugagcggguucaucgcccgccagcucguggaaaccaaccagagugucaaagcggccacaacccugcugcggcgccuguaccccgacaucgacguagucuucgucaaggccgagaacgugacggacuuccggcacgacaacaacuucaucaaggugcgcucgcugaaccaccaccaccacgcaaaggacgcguaccugaacaucgucgugggcaauguguaccacgagaaguucacccggaacuuccgcgcguucuucaagaagaacggggccaaccggaccuacaaccucgccaagauguucaacuacgaugucaaaugcacgaacgccaaggacggcaaggcgugggacgugaagacguccauggacaccgugaacaagaugaugaccagcaacgacguccgcgugaccaagcggcugcuggagcagagcggcgcccucgccgacgccacgguguacaaggccaccgucgcggccaaggccaaggacggggccuacaucggcaugaagaccaagagcuccguguuugccgacgugaccaaguacgggggcaugacgaagauuaagaacgcguacagcaucauuguccaguacaucgggaaaaagggcgagguggugaaagagaucguuccccugcccaucuacuuaaccaaccgcaacaucaccgaccaggaccucaucgacuacguggccuccaucaccccgcaggccaaggacaucaguaucaucuacagaaaguuauguaucaaccagcuggugaaggucaacggcuucuacuacuaccucggcgggaagacgaacuccaacaucuacaucgacaacgccguggagguggucgugcccgccaacaucgcgguguacaucaagguccuggagaaguucgcccugcuccacaaggacaacaacaauaucaaagccagcaccgugaccacccgcaucuacaacgagggguccacgaacaucgugagcaucaccgacaaggacgggcugaucgucuacgacuaccugauguccaagcuccggacgccccuguacaugaagaugaaggggaacaagguggacgagcugucaacggugggacgcuccaaguucaugaacaugacacucgaggagcagagcaucuaccugcuggagguccucaaccugcugaccaacucaaagacuaccuucgacgugaaggcccucggcaucacggcgagccgcagcaccauaggggucaagauccacacacuagacgaguucaagaucaucaaccaguccaucaccggccuguacagcaacgagaucaccaucguguga

SEQ ID NO: 7925 - RNA, 4197 nt, Artificial Sequence
  Cas9 variant
auggagacccagaccagcaaccagcugaucacgucccaccucaaggacuaccccaagcaggacuacuucgugggcuuagacauugggaccaacuccgugggcugggccgugaccaacaccuccuacgagcugcucaaguuccacagccacaagaugugggggucccgccuguucgaggagggcgagagcgccgugacgagacgcggguuucggagcaugcgccggcggcuggagcggcgcaagcuccggcugaagcugcucgaggagcuguucgcggacgccauggcgcaggucgacagcaccuuuuucaucagacugcaugaguccaaguaccacuacgaggacaagaccaccggccauagcuccaagcacauccucuucaucgacgaggacuacacggaccaggacuacuucaccgaguacccgaccaucuaccaccuccggaaggaccugauggagaacggcaccgacgacauccgcaagcuguucuuggccgugcaccacauccugaaguaccgggggaacuuccucuacgagggcgccacguucaacagcaacgcguucaccuucgaggacgugcugaagcaggcccuggucaacauuaccuucaacugcuucgacaccaacuccgccaucagcuccaucagcaacauccucauggaguccgggaagaccaagagcgacaaggccaaggcgaucgagcgccucguggacaccuauaccguguucgacgaggucaacacccccgacaagccucagaaggagcaggucaaggaggacaagaagacgcugaaggccuucgccaaccucguacugggccuguccgccaaccucaucgaccuguucgggagcguggaggacaucgacgacgaccugaagaagcuccagaucgugggcgacaccuacgacgagaagcgggaugagcuggccaagguguggggcgacgagauccacaucaucgacgacugcaagagcgucuacgacgcaaucauccugauguccaucaaggagcccgggcucaccaucagccaguccaaggugaaggccuucgacaagcacaaggaggaccuggugauccucaagagccuccugaagcuggaccguaacgucuacaaugagauguucaaguccgacaagaagggccuccacaacuacgugcacuacaucaagcaggggcggaccgaggagacgagcugcucccgcgaggacuucuacaaguacaccaagaagaucgucgaggggcuggccgacucaaaggacaaggaguacauccugaacgaaaucgagcuccagacccugcugccgcuccagcggaucaaggacaacggugucauccccuaccagcugcaccuggaggagcucaaggugauccuggacaagugcgggcccaaguuccccuuccugcacaccguguccgacggcuucagcgucacggagaagcugaucaagaugcucgaguuccgcaucccguacuacguggggccccuuaacacccaccacaacaucgacaacggaggguucuccugggccguccggaagcaggccggccgcgugacccccuggaacuucgaggagaagaucgaucgcgagaaauccgcggccgccuucaucaagaaccugaccaacaaguguacguaccuguucggagaggacgugcugcccaagagcagccugcucuacuccgaguucaugcugcugaacgagcucaacaacguccggaucgacgggaaggcacucgcccagggcgugaagcagcaucugaucgacaguaucuucaagcaggaccacaagaagaugaccaaaaaccgcaucgagcuguuccugaaggacaacaacuacaucaccaagaagcacaaaccggagaucaccgggcuggacggcgagaucaaaaacgaccucacguccuaccgggacauggugcgcauccuggggaacaacuucgacgucagcauggcggaggacaucaucaccgauaucaccaucuucggagaguccaagaagaugcugcggcagaccuugcgcaacaaguucggcagccagcugaacgacgagaccaucaagaagcugagcaagcuccgguaccgcgacuggggccggcuguccaagaagcugcucaagggcaucgacgggugcgacaaggccggcaacggggcccccaagacgaucaucgaacugaugcgcaacgacagcuacaaccugauggagauacucggcgacaaguucuccuucauggaguguaucgaggaggagaacgccaagcuggcccagggccagguggugaacccccacgacaucaucgacgagcuggcgcucagccccgccgucaagcgggccguguggcaagcacugcgcaucguggacgaagucgcgcacaucaagaaggcccugccgucccggaucuucguggagguggcccgcaccaacaagagcgagaagaagaagaaggacucccggcagaagcgccucagcgaccuguacuccgccaucaagaaggacgacguccugcagagcgggcuccaggacaaggaguucggcgcccugaaguccgggcucgcaaacuacgacgaugccgcccuccggagcaagaagcuguaccuguacuacacccaaaugggccgcugcgccuacaccggaaacaucaucgaccucaaccaauugaauacggacaacuacgacaucgaccacaucuacccccggucccugaccaaggacgacagcuucgacaaccucgugcugugcgagcgcaccgccaacgcgaagaaguccgacauauaccccaucgacaaccgcauccagaccaagcagaaacccuucugggccuuccugaagcaccaggggcucaucagcgagcggaaguacgaacgccugacgcggaucgccccgcugaccgccgacgaccucuccggcuucaucgcccgccagcugguggagaccaaccagagcgucaaggcgaccacgacccugcuccggcgccuguaccccgacaucgacgugguguucgucaaggccgagaacgugagcgacuuccggcacaauaacaacuucaucaaggugaggucacugaaccaccaccaccacgccaaggaugccuaccucaacaucgucguugggaacguguaccacgagaaguucaccagaaacuuccgccuguucuucaagaagaacggcgcgaaccggaccuacaaccuggccaagauguucaacuacgacgucaucugcacgaacgcccaagacgggaaggccugggacgugaagaccagcaugaacaccgugaaaaagaugauggccuccaacgacguacgcgugacccggcgccuccuggagcagagcggcgcgcuggccgacgccacgaucuacaaggccuccguggccgcgaaggccaaggacggcgccuacaucgggaugaagaccaaguacagcgucuucgccgaugugaccaaguacggagggaugaccaagaucaagaacgccuacuccaucaucgugcaguacacgggcaagaagggggaggagaucaaagagaucgucccccuccccaucuaccugaucaaccggaacgcgaccgauaucgagcugaucgacuacguaaagagcgugaucccgaaggccaaggauaucuccaucaaguaccgcaagcucugcaucaaccagcuggugaaggugaacggcuucuacuacuaccugggcgggaagaccaacgacaagauuuacaucgacaacgccaucgagcucguggucccccacgacaucgccaccuacaucaagcugcuggacaaguacgaccuccuccggaaagagaacaagacgcugaaggccagcuccaucacaaccagcaucuacaacaucaacaccuccacgguggugagccucuccaacaaggucggcaucgacguguucgacuacuucaugagcaagcugcgcacgccccuguacaugaagaugaaggggaacaagguggacgagcucuccagcacuggccgguccaaguucaucaagaugacccuggaggagcagagcaucuacuuacucgagguccugaaccuacucacgaacagcaagaccaccuucgacgugaagccccugggaaucacgggcucccgcagcaccaucggcgugaagauccacaaccuggacgaguucaagaucaucaacgaguccaucacggggcucuacagcaacgaggucaccaucguguga

SEQ ID NO: 7926 - RNA, 4200 nt, Artificial Sequence
  Cas9 variant
augaagaccauacugggacuggacuuagggaccacgagcaucgggugggccuuagugaaggaggccgagcccuucuccgacgagaaguccgagaucguccgccucgggguacgggugauuccucugacagucgacgaacgcaccagcuucgagaacggcaaaucuaucacuacgaacgcgcugcggacccagaaacgcgggaugcggcgcaaccuccagagauacaaguugcggcgccaggcccugaucgaggagcuaaagagcaccggcuggaucggcaacgacuucaucuuuagcgagaccggucccggcuccacguuucgcacccugcgucugcgcgccaagagugccuccgaggaagugacccucggggaucuggcccggauccuuuugcagaucaacaagaagcgcggcuacaagucaucccggaagauggugagcagugacgacggacaggcaaucgacggcauggccgucgccaaagaaauguacgauaagggccuuaccccuggggaauacguguaccagcgcaugcuagagggcaaguacgcaauaccggaguucuacaagagcgaucuccaggaagaguucgaccgcaucugggcccugcagaaguccuuccacauugagcugacugacgagcucuaccggaaacucagcgacaggaacaagucacagaccugggcuaucugccgcgacgagcugggaauccagggccucaagagcuccuuuaucggcaaggagcggcugaaggaggccuaccgcuacaggcacuuggccgccacccaagaggugaacauggagguccugacaugugcccuacaagaaauaaacgggcaaaaagccagccugagcggccuccuguccaagaucagcgaccgguccaaggagcuguaccucaacaaucugaccguggggcagaugcugcucaagcgcaucgaggacaacccgaacaacagccugaaaaacaucguguucuaccggcaggacuaccuggacgaguucgagcgaaucuggacuguccaguccaaguaucacacugagcuuacccacgagcugaagaagcggcuacgcgacaucaucaucuucuaccagcggccccucaagucgcagaagggacuuaucucuuuaugcgagcucgagacgaaggacaucgagguggccaucgauggggugaagaagaugaagaacauuggcccccgcgucuguccccggagcucgccgcuguuccaggaguuuaaaaucuggcagaccaucaauaacaucuucgugaacggcgccgcacuggacgaugaggacaagagcgugauagcuaaggagcucauguucaaagacaaacugaaggacuccgaccugcugaaacuccuguuuaagacgaccaaggggcaaagcgucaacuuuaaagagguggauggcaaccgcacgauggcuacccugaugaaggccuguuucaagaucgccgaaaaccucggguacgacgacaucggucugagcaagcugagcuccgaggaccagaugguccggaucgaggggaucuucaaggagcagggcuucaagaccggcuuccuccacuucgauagcucccuagcgagccccgaguucgagaaccaggacuccuaccgccuguggcaucuccuguacagcuacgagggggacaagagcgcuuccggcaaugagagccuugucaagugcaucauggaucucugcuccauggacgaggguuccgccaagauccuggcauccugcacauuccugccagauuacggcucgcucuccgccaaggccaugcgcaagauccugcccuacaugaaggacggguuagaauacacggcggccugcgccauggccggcuaccggcacagcaagcggucccuaaccaaggaggagcuggacacuaaagaguacagcgaccgccugucccuccugccgaaaaacagccuacggaaccccguaguggagaagauccucaaccagaugauaaaugucgugaacuccguaaucgacguguacggcaaaccagacgagauccguaucgagauggcccgggagcugaagaagucggcaaaggagcgcgaagaggcccaacgagacaucgccuccagcaccgccgagucccagaaggugaucgagauccugaagggggaacccuucuuccugcaguucccgacgcggaaugacaucauucgcuaccggcuguaccaggagcuugcgcagaauggcuucaaaacccucuacagcaauaccuacauccccaaggauaagcuguucagcaaggaguucgacaucgaacacauuaucccccaggcccugaucuucaacgacuccuucgccaauaagacgcucgagagccgccagugcaacuuggagaaagggaaggagacagccauggacuauguaaaaucuaaguacgacgaaaccggcguacaaaccuauugcgaccgggugaacggucugaucgggaagggcaucagcaagaccaaggccaaguggcuccucauggaggguaaggacauccccgaagacuucaucaaucgcgaguugcgggacucccaauacaucgcgaaaaaggcccgcgagauccucgagagccuggucaaauucguggugccgacuacaggcuccgugaccgcccgguugcgggaggacuggcagcucgugaacgugaugcaggagcugaacugggagaaguacgccagguuggggcucaccggcguccgcgaggacaaggacggcaggcgcauccccuucauccaggacuggacuaagcggaacgaccaccgccaccacgccauggacgcacugacgaucgcauucacccggcgccaauuuauacaguaccucaaccaccucaacucgaagaucgacguaguguccugggacaagaaagaucuagaccugagagacuacgaccucgaggacauuaaguuugguaaccugagcgccggagaccgcuacgggaucguaaaggcccugcaggacaaguuccucuacaaggacggaaacgacaaguaccgguucgugccgcccaucccccuggacgaguuccgccgccaggcgaaggagcagcuguccgauauccugauuagcuucaaggccaaaaacaaaguuugcaccagaaacgucaacgugaccaagaacaagggcggugcgaaccgcaaggcccaacugacgccccggggcccuuuacacaacgagaccaucuacggguccagccucgaguacgugaccaaggagaacgagaagaucggcuccagcuucgacaccgagcguauuaccacgguuugcaagaagaaguucagggacgcucuugcccgcaggcuugaggaguuuggcggcgaccccaagaaggccuucaccgggaagaacuccccggagaagaacccaaucuggguggaugagcaccacagcgagcaaguacccgccaaggugcgcaccgugacaaugggccagcgguuuaccggccgcaaaccuaucgacgccacucuaaagauagagaagguaaucgacaagcggauccgcgagauccuucaggcccggcuugacgaguuugacgggaaggcggcgaaggccuucuccaaucucgacgagaaccccauuuggcugaacaaggagaaaggcauagcgauuaagcgcgucaccgugagcgggccggcuaauccugugccgguccgguucaaacgcgacaaggacggcaagcccaucaucgacgacgcagggaagaccaucggcgccgacuucgugacccccggcaacaaccaccacaucgccaucuuuagagacagcuccgggaaacuucaggagcaccccgugagcuuccucgaggcgaccauugcaaagucacacggccuggacgucaucgaccgcaacuacaacaaggacgaggggugggaguuccuguucacccucaagcagaacgaguacuuuguguucccgaacagcgagacgggcuucaacccccuggacuaugaccugaccgacccccggaauuaugccgagaucucccccaaccucuaccgcgugcagagcaucuccaccaaugauuacuuuuuccgccaccaccuggagaccacgagcgagaagaacaacucucucuacgggaucaccuggaagcggauccgcaacgccucggccuuagaggggcuggucaaggugcggauagacaacuuaggucgcauuguagccgucggggaguacgacuga

SEQ ID NO: 7927 - RNA, 4200 nt, Artificial Sequence; identical to SEQ ID NO: 2127
  Cas9 variant

SEQ ID NO: 7928 - RNA, 4200 nt, Artificial Sequence
  Cas9 variant
augaaccugcgcaacacgaccgaugaguacaacauaggcuuagacauggggacgaacagcgugggcugggccguaaccgacaaggccggggcgaucgcccacuucaagggcaagcccacccuggggucccgccucuucgacgccgcccagaccgccgcgggcgcccggauccaccggagccagcgccggagauacgugcggcgccgguggcgccucgaccugcugcagucccucuuccaggacgaggugucuaaggucgacuccgaguucuucugccggcugcgccagagccggcuguacgugggcgaccgcgaaaaggggcacgccgacuacacguggccgaucuucaacgacuccgacuucaacgagguggacuacuacaagcgguuccccaccaucuaccaccuccgcaaguggcugauggagaccgacgagaaggccgacauccggcugaucuaccucgcgacacacaacaucgugaagcaccgcggcaacuuccugcgggagaacaacaagagccuauccagcagagacgcgaaccccgcacaggccgugaagucccuccggcuggcccugaaugacuggugcagcgagcgcgacuacgagugcgcguggaagggggaggaggacgacggcgccaucgacgaggccauccuuaacgugcuggcagacggcgagaagggccgcagugaccaggccaaggagaucgcgaaguuaacgggagucgacugcggggacgccaagcaaagcaagcagugcaacgaggccaucgccaaggccauugugggccucaagguggaaaugaaaaacaucuucggggaguuucccgcggagaagaccuccuacaucuacuuaagcuccgacgaggacgucgaggccgugcgggagagcugcccggaugauuccggcgagcuguuccaggcccucugcaagcuguacagcgcguacauccugcaggaacuccugagcuacgcagaccccuccggccaaaccaucagcgcgaacaugguggccaaauacaagcaguacgggcgcgaccugcggcuccugaaggagcugacccguacuuacgcgccccagaaguacgaccucuucuuccggggcgagaccuacgccgggucgucagacuacgucguggacgaggcccgcggcuacacccgguacaaccuggggaccacgaaggccaacuacgacgacuuccagaaauccgugaaggagcuguuuaagggcaccgacgcccuccaggacgagcgcuaccaagagaugauggucgccuucggcgagcagaaguuccugcggcgccugaaaacuagcgacaacggguccaucuacuaccagcuccacuuagaggagcugcacacaauccuugagaaccagggcaagcacuaccccuucuuacugucugaggaggacaagaucgagucccucgugagcuuccggauaccguauuacguggggccccugacgcgcaagaacgccgcgaucggucacgacgggaaagagcgguucgccuggucaagccgcaaggacggcauggagcacgccgucaucaccccauggaacugggaagagauaaucgaccgggacaaguccgccgaggacuucaucaugcguaugaccggcgacugcacguaccugcagggggagcccgugcucccgaagugcagccugcuguacgaggaguuuugcgcccuaaacgaguucaacggcgcgcacuggacgguggacggggacgacgagcggcgcuucgacgccgcccagcgggagcgcaucaugugcgaccucuuccgccggacccgcuccgucaccuacaacaaggugagcgacuggcuggagcggaaguacaacuucaccggcgcgcgcguccgcgggggccaaggcgagcacggguucgaguccaaguuagguagcuacaucuucuucuguaaggacguguucaagacggacgggcucgacgaggcugauuacaccaugaucgagcagaucauccuguggucgacacuauucgaggaccgggacauccucaagcggaagaucgaggaggcguacggcggcgaccggcugaccagcgagcagaucaaggucaucugcaagaagcgguucacgggguggggccgccugagcaagcggcuccugaccgacaucaaggucaacacugacaccgggaggaaguccaucauggacgugcugcgagagggcaaccccaacaacggacagcgcagccggacgaugguauucauggagguccuccgugacgaggaccugggcuuccagaaggccaucgacggccugaaccgggacuacuucagagagcacaacaauggucucauggacguuaacgacuugcccgggucccccgccauccggcgcucuauuaaccaggccguccggauagucgacgagaucgcguccaucgcccgcaaggagccgacaaacaucuucaucgaggugacccgugaagaggacgacccccggaagaaggggaagcgcaccaagcggcgcuacgacgccaucaagucggcccuggagaaguucaagaaagacgacccgucgcuguggaaggagcugugugagaaggcccccggcgacauggacgagcgacugagccucuacuucaugcagcgcgggaagugcauguacuccgggcggccgaucaagaucgaggagcugcacaccggcaaguacgagguggaccacauaaucccccgcagcuacaucaaggacgacuccuucgagaacaaaguccugguguaccgggaggagaaucagcacaagacggacgcacuccugaucgacagcuccauccgccagaagaugggcggguauuggcggaugcugcacgacgcgaaacucgugggggacaagaaguuccgcaaccuguucaggaaccacaucgacgauaaggccaugaagggguucgucgcgcgccagaucguggagaccagccagauggucaagcugguccagacccucuucgaggcccgguaccccaacacccgcaucgugcccgugaaggcggggaucucccaugaucugcgggaggccgccggccuugucaagugccgcgaggcgaacgacuuccaccacgcccacgacgcguuccucgccugccggaucggccuguucauccagaaaaggcacccgagcguguacgacaaccccauagggcuggcgcgcaucaugcgggacuacgcccgaaugcaggcgcgggaguacaagaagucccacugccucgcccacacgcagggcuucaucgugaacagcuuccugucguccggguucgacgaggagaccggcgaaaucuucaaggacgacugggacgccaaggccgaagucgaggggauccgccgggugcugaauugccgccaaugcuucaucagccggaugcccgucgagggagacacccgcuacggcgggcgguacuggggcgagaccaucuacucgcccaaggggaagcacaagcacgagaucccguuaaagcagggccuggaccccaaccuguacggcggguacagcgaccuccuguacuccuacuuccugaucuacgaggccagcgacgucuccagcggugagcgcguacucagguucaucgggauccccacguccaucgcggcccgcauggccaaccaaaagcggcuggaggaguacgugagccgccuggcccuccaggagaaccuggagcacguccggauggugcgcaagaucaugaagaagcagcucaucgagguggacaacugccggcuccuggucaccgccgcggacgccgugaccaacgccaccgagcuggccuucucccucgaugagaugaagaucaucagcacgugugccaagugcaucaauggcgcggacccguccgcaaucgacaagaucgggaacgcccaggacagcuucuucgacaaccugaagcgccggggcuccgaccgcugugcccuccuguucagccagcuuaaguuagacaagcucucccagaacuucuacaugaucagcuccgacgacaaaagcaagauccugauaagcaucuuagaccguaucagggccaaguccaacagcguggaccuaucccuggucggcggggcgaagcacgcggcccaaaugaaguucgacuucaaugccaagcugaacaaucccgcgagcaguuucgugcucaucgaccagagcgugaccggcauguucgagcgacggacgcgcaucgggcuguga

SEQ ID NO: 7929 - RNA, 4203 nt, Artificial Sequence
  Cas9 variant
augaaccucagaaacgcgaccggagacuauucaauaggccuggacuuaggcaccaacaguguagggugggcgguaacggacagcaacggaagcauggcacauuucaaagggaagccaacccucgggucaagacuauucgacgcugccgaaacagcagccggcgcacgacaacaccgcggccaaagacgccgguacgucagacguagguggcgacuagacuugcuccaaggacucuuccaagacgaagucaacaaagucgacucagaguucuucauacggcuccgacaaucccgacuccacguagaagaccgagcggagggucacgcagguuacagguggccacuauucaacgacacagacuuuacagaaaaggacuauuacaagcgguuccccacaaucuaccaccuccggaaauggcugauggaaacagacgaaaaagccgacauccgucuuaucuaccuagccgcccacaacauagucaagcaucgaggaaacuuccuaagagaggacaacaaaaaccuauccagccacaacgcaaaucccgccgaggccguccgaagccugcgccaagcgcuagacgacuggugcgccgaacggggauacguaugcgcguggaccucaguagacgaccucgcagaagcagacucccacauauuagauauauugaccaacucgaaagaacggagagcggaccaggcaaaggaacuggccaaacuauucgguguagauugcggggacacaaaacaaagcaaaucaugcaauagcgcccuugcaaaagcgguugugggccugaaaaccgagcuaaaagacguauucggcgaauuuugcgccgagaaaacggccauccacuuaucuucagaugaugacguagaggcaauccgggacgcaaucccagacgacuccggggagcuauuucaaguacuaugcgcgguauacagcgcguauguacuccaagaacugcugucguacgcucccggccaaaccauaagcgcaaauauggucgccaaguacgaccaauaugggaaggaccucaagcuacucaagaaucuggcacgcacauacgugucgcgagagaacuaugacgccuuuuuccgaggacagacguacgaggauucaaacgauuacaaugucgauaaagcacaaggcuacacaagguacaaucuaggcacuacgaaggcgucguacgaugacuucaagaaaagcguggaaaaacuuuucaaaggaacacaagccgagcaggauaaaagguaccagggaaugaugaagagauucgcggaggagaaauuccuucgccgccuaaagacaucagacaacgggaguauauauuaccagcuccacuuagaagaacugcgagcaauacuaaagaaccaaggaaagcaccauccauuccugcuggaggaagagaagaaaaucgaaucgcuagucucauuccgaauccccuacuauguagggccacucagcaguaaaaacgcgucucucgaccacaaaggcaaacaaagauucgcauggucggagcgacgcccggggaugaaagacacugucaucaccccguggaacugggaccaaaucauagacugugaucaauccgcagaaaaauucauccuacggaugacgggcgauugcacauaccuacaaggcgaaccaguacuacccaaaugcucgcuccuauacgaagaauacugcguccucaacgaacugaacggagcacgguggaccauagacggcgacgauuggcgaagauucgacguggcacaacgagagggcauacuacacgaccuguuccgaaaaaccagaagcgucgcauacaacaaagucgcugauuggcuagagcgcgaagagaauugggcaaacgcacacguaagaggcggacaaggagagaacuccuucgaaagcaaacuuggaucuuacaucuucuucuguaaagacguauucaagaccgcggcccucgacgaagcagacuacccaaugaucgaacagauaauucuguggaacacacucuucgaagaccgcgcaauacucaaacggaaaaucgaacaggccuacggggaacaccacggaggaaaauuaacagaugagcaaauaaaagugaucugcaagaaacgcuucacaggauggggaaggcugagccggaagcuccuaacugguaucaagguggacgcggacacaggucgaguguccauaauggacguacugcgagagggaaauccaaacgaaggacagcggagccgcaccauggugcucauggaggugcucagagacgaagacuugggauuccaaaagaaaaucgacgacuucaacaaagcauacuucgccggacaaggagaaggacuaaugagcgugaacgaccuccccggcuccccagcgauccggcgcuccauuaaccaggcgaucagaaucguggacgagauugcguccauugcgggaaaagcaccauccaauguguucauagagguaacucgagaagaagacgacccccgaaagaaaggacggcgcacgaacagacgcuacgaggacaucaaaaacgccuuggaaaacuucaaaacagaggaccaagaacuauggagugaacuucucggaaaagccccaaacgaccuagacgagcgccuaucauuauacuuuaugcaacgggggaaaugcauguauagcggcaggcccaucaaacuagaagaacuccacaccggcaaauacgaagucgaccacaucaucccccgcaguuacauaaaagacgacagcuucgaaaacaaagugcuagugugccgagaggaaaaccaaaggaaaaccaacgaaaugcucaucgacccagcaaucagacgccgcaugggagacuacuggcgaaugcuccacaaagcaaaacuuauaggcgacaaaaaguucaacaaccucuucaugagagacagaauagacgacaaaacgcuaaaaggcuucgucgcccgccaacucguagaaacuucacaaagcgucaaacuuguacaaacucuacuagaagugcgguacccgaacaccaaaauaguccccgugaaagcuaacauaagccacgaccugcgagaagccgcggacuuagucaagugccgggaagcaaacgacuuccaccacgcacacgaugcuuaucucgcaugcagggugggacuguucauucagaaacgccaccccagcguguacgcaaacccaauaggcuuaucccggguuaugcgggacuacgccagaaagcaggccggcgaauuuaacaaaacccacagcauggcccacacaaaaggcuucaucguuaauagcuucaugacaucugaguucgauaaggaaacaggagaaaucuucugggacgcagaagccgccguggaagacauccgccggguccucaacuaccggcagugcuucaucucgcgaaugccaguggaagacaccggagcguucugggaucaaacgauauacucaccacggucaaacaaacgacuggaacugccccuaaaagacgacuuagaccccaacaaauacggauccuacagccgagaacaguucgccuacuucuuuauauacgaggcacgagacgcaaagaaaagcaaaaccguacuacgauuugcacaaguccccgugcgaguaacaagcgcaauugcaagggacuccagcaaacuagacgaauacgcgucggggcuggcuguccaggaaggccuggaguucacuaaaauaauaagacgccgaauacucaaaaagcaacuacuggaacuaaacggagaccgccucgucaucaccggggccaaagaggugcgaaaugcaacagaguucgccuucacguuagaagaaacagcacuuguggcgaugugcagcgaaauugcacgcgaagguguucccagugaaaucgccagcgacgugcaaagcaucucgucgcaacucucggaccucuuccuugcccugaucgagagaggcuuaacgaucggcguccgccuccacggccaacucaaacuuggccaguaccucagacaauucgaagaugcagcgcuaagagacaaggccaaagugauaaucgggauaauaagcauuaccaacggggcgacaaauacacuugaccugaguucccuaaacggcucuaaaaaugucggacaaguccggauuacccacaacaagcugcuaaacgacaaaucaaccucguacguacuuaucgaccagagcguaacgggcauguucgaaaggcgcacccguauaggcuuguga

SEQ ID NO: 7930 - RNA, 4203 nt, Artificial Sequence; identical to SEQ ID NO: 2130
  Cas9 variant

SEQ ID NO: 7931 - RNA, 4203 nt, Artificial Sequence; identical to SEQ ID NO: 2131
  Cas9 variant

SEQ ID NO: 7932 - RNA, 4203 nt, Artificial Sequence
  Cas9 variant
augaagaccaucacagaggacuacauccugggccucgacaucgggacgaacagcugcggcugggccgugauggacaagaagaaccgccugcugcggcuccgcgggaagcgggccauuggcucccaccuguucgaggagggucacagcgcggcggaccgccgguccuuccgcacaacccggcgccggcugaagcgccgcaaguggagacuccggcugcuggaggagaucuucgccgagcccauggccaagguugacccggccuucuucguacgccuccaccagagcugggugagcccccuggauaaggaccggaagaaguaccacgcgaucgucuuccccaccgccaaggaggaccacgaguucuaccacgacuaccccacaaucuaccaccuccgcgacgcccucaugcgggaagaccgccaauucgaccugcgggagaucuuccuggccauccaccacaucgugaaguaccgcggcaacuuccuccaggacaccccggugaacagcuucgucgcguccaagaucgacguggccagcuuccugaccaacgugaaccaggccuacgccgacaaguacggcgaggagcagaacuucaucgagcugaacgagaacaacgccgcggccaucgaggccgucauccgggggaaggacaaggacaagaccacgaagcagcucgacaaggccaagaagauuaccaaacuucugcaguccagcaccaacaaguacgagaagaacgugacccgccagaucgccaacgcgaucaucggcuacaagacgcaguucgagaccauccucgggaaggacaucgacaagaacgacaaggccgacugggaguucaagcuguccgacggcgacgccgacgauaagcuggagaaccuccugcccgaguucgacgacaacgaccaguacaucguggccgagaucaagaagcuguucgggagcaucgcccucucccagaucgucuacgagaacaugacccugagccaguccaugaaguguaaguacaaggaccauggcgacgacuaccaccuccucaagcaguacaucgcgacccugagcgaucacggccaggugcgcaagcugcuucuggccuacgaccuguacgugaacaaccggcacgggcgccuccuggaggccaagaaagaauuuaagcaggauaaggcccugacgcaggacgaguucuacaagaucguccgggaaaaccucgacaacucccagcuggcccagaagauccugcaaaagaucgaggaggagaaguucaugcccaagcaacgcgugaacaagaauggguucauccccuaccagcuccaccagaucgagcuggaccagaucaucgcgaaccaaagcaaguacuacccguuccuggccgaggagaaucccgugaaggagcaccggaagcaggcccccuacaagcucgacgagcugguccgcuuccgggugcccuacuacguggggccgcugaucucccccgacgacaagcgcaaggacaagcagcagaacaagaaccacgagauguucaaguucgccuggaugaagcggaaggauaacaacggcgcgaucacccccuggaacuucgcccagaaagucgaccgcgagacaagcgccaaccgguucaucaagcgcaugaccgugaaggacacguaucucaucggcgaggacguacugcccgcccggagccugcuguaccagaaguucgagguccucaacgagcugaacaauauccgcgugaacgggaagcggcuggagcccaaguucaagcagaaggucuucaacgagcuguucaagcagaagaacaaggugaccaagaaggccuucaaggaguucauccugcagaacaccggcaugaaaaccgcggagaucgacgggcuggccgaccccacgaaguuuaacuccagccucuccagcuacuaccaucugaagucuaccaagguguucgacaagcagcuggacgaccccgaguaccaggccgacuucgagaagaucaucgaguacagcuccaucuucgaggacgccgagaucuaccaggagaagcuccacaaggagaucaaguggcugauccccgcgcaguuuaaggcgaucgccaacuggcgccugcagggcuggggacggcucagccgcaagcugcuggucgagcucaagggcaagggcggggagaacauaaucuaccagcuguggaccacccagaagaacuucaugcagaucgugaaugagccagagcugaagaaggccaucgugaaggagaaccaccaggccacggaggagaagggcaucgagaagauccucgacgacuccuucaccagccccgccaacaaaaaggcgauccggcaggucaucaaggugguggacgacgucgugaaggccgccgggggcaagaagcccgcccaguucgcgaucgaguucacccgcgagcccaaguggaacccgcagcugucccacauccgcggaaccaagcugcuucagguguacgaggacacggccaagaagcuggucgaccagagccugaccgacucccucaaggagaacaugaccaaccggaaccugcugaaggacgaguacuuccucuacuucauccagugcggccgcgacgccuacaccggcaagaagaucgacaucgccgacauccacaagaaguaucagaucgaccacauccugccccagagcuucaucacggaugacucccuggacaaccgggugcucaccgagaucgagauuaaccagaagaagcacaagaaguacgccagccaccuguucgcgaccaagcccgccuucgggcugaaccaguccaucagcgagauguggaagaccuggcagaaggccggccucaucucccagcgcaagcugaacaaccugcuguucgaccccgaccuggugaaggacaagcagaagaagggguucaucaaccggcagcugguagagacgagccagaucaucaagcucgugucgaucauucugcaggacaaguucccugacacggagauuaucaccgugaaggccggcuacaacacggcccugcgcaaggagcucaagcuguacaagucccgggaagcgaacgacuaccaccacgccaucgaugccuaccugaccgccaucaaugacaauuuccucuaccaggucuaccccaacuuccgccccuucuucguguacgggcaguucaagaaguucagccaggacacggacaagcagaaggaggccaucaaguauuacggccugaagaacuuccuggagccacuccuggacgacuccaccggcgacgaggugauggucaaccauacgaagcacgugguguuccacaagcagcgggauauuuucaaccgccugauccaggcguacaacuacaaguacaugcucgucagcagagagaccacgaccgagaacuccaacauguuuaacaugaccaucuacccccgcggggagcgggaccgcaagaagacgcggaagcugauccccaagggcaaggaccuggaucccgccaucuacgggggcuacagcggcaacacggacgccuacauggugaucgugaagaucgagaagaccaaggagacccucuacaaggucgugggggugccgaugcgcgcccuggcguccuuaaagaaggcccagaaggaaggcaacuacgaccaggagcucaacaagguccuggagccccugaucauguucaacaagaacgggaaguccaaggccggcaucaaaggguucaccguggugaaggaccacguccacuucaagcaggucgugaucgacggcgacuccaaguucaugcucuacagcgcccaguaccgggccaacgcgaagcaacugacgcugucccaggagaccaugaagguggugaccgacaacaccgacgacauggaccagaagaacgccgacaaggaccagcuccugcugaacgccuacgacgagauccucgagaagguggaccaguaccugccccuguucgacaucaacggcuuccgccaagggcuccacgacggccgggccaaguucgccgcgcugaagacgagcgagaagaaguacacccugaagaacaucuuaaacgggcugcacgacaaccuggucacccccaaccucaagaacaucggcaucaagaccccauucgggcugaugcaguccagcuccggcaucacgcucagccccaacgccaagcucguguuccagucccccaccggccuguucgagaagcgcgugaagcugaccaaccucuga

SEQ ID NO: 7933 - RNA, 4203 nt, Artificial Sequence
  Cas9 variant
augaagaccauccuugggcucgaccuggggacaaacagcauaggcugggcccuggugaaggagacggaaaacucuaaugagaaguccgagauuaucaaguuggggguccgcgugaaccccuugaccguggacgagaagaccaacuucgaggccggcaggccgcucuccaccaaugcagaccgcacggcaaaacggagcgcccgccggaaccugcagcgcuacaagcugcgacgcaagaaccugaucgaccuccugaucaagcaccggcugaucgacaaggacacgccccucaccgagaucgggaagaauaccacccaccagacccuggaguuaagggcuaaggccgcgcgggagcgcaucgagcucgaggaccuggcccgggucuuccuggccauaaauaagaagagaggcuaccgguccagccgcaaggugaacaacgaagaggagggccagguggucgacgggauggccguggcgaagaagcucuaugacgagaaccugacccccggccaguacgcguacgagcugcucucaaaggggaagaaauacgugcccgacuucuaccggagcgaccugcaggccgaguucgacuccaucugggaguaucagaagcaguucuacgccgacauccuggacgacgagcucuauaacgcccugaagggccaggggcagcagaacagccgcaagcgguuccuggcgauaaagggcgucuacaccgccgagaacaagggcaagcgcgacgaggugaagcuccagcauuacaaguggcgguccgaggccaucacgcaaaagcugagcaucgaggagguggccuacguccugguggagaucaacaaugaccucaacaaguccagcggguaccugggcgccaucuccgaccgcagcaaggagcuguacuucaacaaggagaccgugggggagaaccucuggaaacagauccagaagaacccgcauaccucccugaagaaccaggucuuuuaccgccaggacuaccuggacgaguucgagcagaucugggaaacccaggcgcaguuucacccccagcucacgcuggcccugaaggaacagaucagggacguggugauauucuaccagcgcaagcucaagagccagaagggccugcuguccuucugccaguucgagagcugggagaucgagaggaaagacgagaacggcaaugucauccucaacaaaaccacccagcugccuaagcgccagaccguggggcggcgcguugcccccaagagcagcccgcuguuccaggaguucaagaucuggcagaacaucaacaaccucgagaucgccaagaucagcgacgguaacaguaagaacaagaaggagacggaggcccugagcgacgaugaaaggaagcuccuguucgaggagcugaaccugcgcgggaacuuaucccagaaggaggugcugcagauccugggccugaaggacaaggaguacaagaccaacuuccccgagggucucgagggcaaccggaccaacgcggcccuguuuaacaucuaccagcagaucgccgagaacgagggcuacggggacuggaccaaaaaguccgcccaggagaucaaggaggagcugaaggccguuuucccccagaucggcauccaggcugacauccucgacuucaacgccgaguuggacgggaaggaguucgaaaaccaggcgagcuaccagcuguggcaccuccuguacagcgccgaggaggaugacaagaucaacgaggaggaccagaucaucuacggcaacuccgcaguuagccugaagaagaaacucugcgaaaaauucggguucacgcccgaguacgccaaguggaucgccaacgucucccuccaggacgacuauggcaacuugagcaccaaggccaugaggaagaucaucccguaccucaucgacggcaacgacuacuccgaggccugcgcgcuggccggguacaaccacagcaacucccugaccaaggaggaaaacgacaacagggagcgccucaauaagcuggagcuucuccccaagaacagccuccggaaccccguggucgagaagauccugaaucagauggugaacgugguaaaccaggugauagagacuuacggcaagccugacgaggugcgcaucgagcucgcccgggaacugaagaaguccgcugaggagcgcgccgagaugacgaaagggaucaacgaggcgacccggcgcaacgaggacaucaagaagcugaucaccaagaacuucggcaucccuaaccccaccaagaaugacguggugcgguaucgccucugggaagaacuggcgccccuggccuacaaggacguguuuacggggcgccagaucaaaaaggaggaccucuucagcuccaagaucgacaucgagcacaucauccccaaggcccugcuguucgacgacagcuucagcaacaagacacucgccuuccgugagaccaaccugaagaaggccgaccgcaccgccuacggcuucaucgaguccgacuacaacgccacgcuggacgacuacauccagcgagucgagacccucuacaacaacgccaagggcaccauuagcaaggggaagcgcaacaagcugcugauggcgcagaagaaccucccggacggcuucaucgagcgggacuuacgcaacucacaauacaucgccaagaaagccaagucuaugaucgagaagguguucaacgaugugaacgugaccuccgggaguauuaccgaccggcugcgcgaggacugggaccucaucaacgugaugaaggagcugaacuuccccaaguacaaggcccugggccucacggagaucgaggagcgguacgacaucggccaggagaagaccaagaagguggaggucaucaccgacuggaccaagcgcaacgaccaccggcaccacgccauggacgcgcugacggucgccuucaccaccaagucccacgugcaguaccugaacaaccucaacaccauccacagccugaagggggacgaggucgaccuggagcucagcaaguuauauggcuuaaagaacacgaucaccgagguggugaacaagaagcgcaaguucaucccgcccaugcccaacuuccgggaggaggccaagaagcacaucgagaccauccucgucagcaucaagaacaagaacaagguguacaccaagaacaucaacaagacgaagaaggaguccggguaccacaccaaggagcagcugacgccgcgcggccagcugcacaaggagaccguguacggcaagagcaagcggcccaugaacaaacccaccaaaaucaacaaaaacuucucccucgagcaggcccagcugaucaucaacguccaggagaaggagcuggugcuccgucaucuggcccaguucgacaacaaccccgcgguggccuucgacaccaagacccugaagaagaugcccuugcugaagaacggggagccccugaaggagguccucugcuucgaggagaucuucaccauccggaaggacaucacgccggaucugaagaucgagaaagugguggacgagaagaucaaggccauccuagagcagcgcaagaaggacuucggcgggaacgccaaggaagccuucagcgaccucgacaagaaccccaucuggcugaacaaggagaagggcaucugcaucaagagggucaccauuacuggcguguccaacgcggaagcccugcaucaccagaaggaccaccucggccgcgagauccuggacgauaacgggaaccccauccccgccgacuuugucucaaccggcaacaaccaccacguugccaucuacgaggacgagaagggcaagcugcaggagaaaguggugucccuauacgaggcggucgcccgggccaaccaagggcugccggugguagacaagggccugaacgaagaccucggguggaaguuccuguucacgaugaagcagaacgaaauguucgucuuccccaacgacgacuucgacgugaacgacaucgaccuccucgacgagaacaaugccaagaucaucagccagcaccuguuccgcgugcagaagcuggccacaaagaacuacauguuccgccaccaucucgagaccaacguccaggaggugaaggagcugaacgacaucgcguacaagagcauacgguccacagagccccugaagaacaucaagaaggugcgcaucaaccacauuggcaagaucguccagguaggggaguacuga

SEQ ID NO: 7934 - RNA, 4209 nt, Artificial Sequence
  Cas9 variant
auggccaagaaggacuauaccaucggccuggacaucgggaccaacagcgugggcugggccauuaucgacgacaaccucaagcugcugaagcgcaacaugacgaucaaggggaacaccgacaagaaguccgucaagcgggaccuguggggcagccugcuguauuccgggaacagcgacaagaccaccucugcggccgacgcccgcagcaagcggggccuccgccggcgccugcggcgccggaaguaccgccuggaccggcucaagcagaucuucucugagaucaucaacgacaaagcccccaacuucuucgacaagcugaacgagagcuuccugaaccccaaggacaagaaauacggcaaguaccagauauucgacacggagaaggaggagaaggacuacuaccgccgguaccccaccaucuaucaccuccgcaaggaccugaucgaguccagcaagaagcaggacauccggcuuguguaccucgcccuggcgcacauccucaagagccgcgggaacuuccuguucgagggcaacaucgacgaccugaagaacgacuucgccgggaucuacgaggagguggucgagcugugcaugaccauaaacgccgaggacguggaccucgaguucgaggagguggacaagcagagccugaacuccaucaucaagaacgaggacaucagcgagaucgagcagggccuggagaacuucgccgaugagcacgucaucuuuaaggagcagaacaagaagaagaacgaccucuucuccaacugcugcaagaucaucugcgggcacaccgugaaggcgaacaaguucgcaagcgagcuagacagcgagcuguucaucagcuucaaguccgaugacuacguggacgucaucgacgugauccagagcggcaacgagaacaucgccaaccuccugcuugccugccggaaggccuacgacuacaucauguuuaaccgccucguggaccugaacaucgacagccccgcgaagcuguccagcaauauggucucccucuacaaccagcacgagaaggaccucaaggccuacaagaagcugaucaaggaguucaacaaguucaagcggagcaacggcugcaaggaccucgagaugaucauccugacggccgacgacaucgacuccuuccgcaagaaaguggacaagaaggaggggaagcugaacggcaucaacaagaaaaucacccacgagcaggcccucaagaagcagcugaaggacaugaagaagauccuggaggacaagaacaccgaggccgaggacaagcagaucaacgacauccucaagaugauuaccagcaucgaggagcggguaaacaaguccugcuuccugaagaaccugcgcuccacggacaacgcguccauacccaaccagauccagcgccaggagauggaggccauccucgacaaacaggccaaguucuacccguuccugaacgagcacaaggacgagcugcuccagcugcugagcuuucggauccccuauuacgucgggccccuggugaacaagaaguacucccgcuucgccuggcucgugcggaaggagggccagguccagaagaucacccccaccaacuucgauggcgugguagacaagcacaagacugccgagaaguucauggagcgccugaucgggaaggacgucuacuuaccgaacgagcgggugcuccccaaggcgucacugcuguaccaggaguacugcaucuucaacgagcucacgaagguggccuacaucgacuccaccggcaagaagaacaacuucagcuccgaggagaagcugaacauauucgagaagcuguucaagaccaagcgcgaagucaccaagacggaccucugcaagugccugaacaacguuugcaagcugaaggaaaaggucaaggagaccgagaucaucgguauaaaggcgaaguucaacgccaaauacagcaccuaccacgaccucaagaagaucaacggcauggagcagcugaucgccgacgaggaggggaagccccugugcgaggacaucaucuccauccucaccaucuucgaggacaaggauauccggcugguucgccuuaaggagcuccugugccagaauaaggaccugaucaacaaguucagccucuccgcggagaaguuagccaaggugcugagcacgaagcacuacaagggcuucggcaacgucuccgccaagcucaucaacgggauccgggacaagaacugcaagaccauccuggacuaccugaucgaggacgacaaggaggccuacuacggccgcaacaaccccaaucggaaccucaugcagcuggugaacgacucccgccuggcguucaaagggcagaucgaccgggagcagaacacccaccucgaggaccugagccuggaugaguuccucgacgaccuguacgugaguccguccauccgccggggcauccgccugaccauccgguuagucgacgagcugguggagaucaugggauaccugcccaagaacaucgugaucgagaugccccgcgaggacggcgagaagggcaagaucgccgacacgcgguauuccaagcucgagaagaugcugaagaaggacgccgcccuggaggaccucuaccgcgugcugaagaccuaugagaagaacaagaaggcucuggcgaacgacgcccucuaccuguacuuccugcagaacgggcgcgauauguacaccggcaaggagaucaaccucagcgaacugcacuccuacgacaucgaccacaucauccccaagagcuucaaguacgacgacucccuggacaacaaggugcucaccgccaaaaagaugaacauggacaagcggacgggggcccuagaccacaacaucaucgagaaccagugcggcuucuggcgcgugcugcuccagcaggacaagaucagccuggaaaaguacaccaaccugaugaagaccgaguucaccgaggccgacaaggcgggguucaucaugcggcagcucgucgagacgcgccagaucaccaaguucgucgcccgguaccuggacaacaaguucaacggccugaucuccgacccgaacgacaaggugaacauccuccugccccgcgccagccugugccaccaauuucgggagaccuucggcuucuacaagguccgcgagcucaacgacaugcaccacgcccacgacgccuaccugaacgcggugaucgccaacacccugaacaagaacgccuaccucuccgaccugcuuaaguacggggccuacagcaaguacaagaagaacggcuucaacaacuccaacgggaucauggacuacuucggcaacacccaguucaacugccucuucguggucgagcggacgcuggacaagugccgcgugaacaucgucaagcaccccgagaccgcgagcggcgaguucuacaacgagaccauccagaagaacaaggucaacggcggcagcagcacccggagccugaaguccagcgugaaggugcuccagaacacggagcaguacgggggcuucaccaacgucaacaacgccuacuucauccuguucgacuacaaagccaaguccaagcugaagagaaagcucaucggggugcccaucguggaccggcagaaguucgaacaggacccggucaccuaccuggaggccaagggcuucgacgagcccaagcuggugcagaagcuccugaaguacacccugcucgaguacgaggacggcaagcgccgguaccugacgggggugaccggcaagcgcugcgagcugguccgggccaaccagcuccugcugccccgcaacaugauggcgcuccugcaccaccuccaggaguggcagaagcacgacuucgggaucaaggagaugaccaaggugauaaagaacaccaacaacaucgaggccaaguucgacaagcuguucgagcacaugaugaaguucaucgacaaguacucggaaccacccaagaucguguccagcaagaucuccgaggaguaccacaagcugcgggagagccugugccaggaugacaacaagaucaagaucuacgccgagaucgggaaggcucuccugucccugcugcaccucgucgacagcaaauccgccugcguguucaaguucagcggucuggagaucaaccgcaucagauaccagucaaucaacgagaagaaggagcccgugaucaucuuccagagccuguccggccuccgcgagagccgcuacaaguacaaccaguga

SEQ ID NO: 7935 - RNA, 4209 nt, Artificial Sequence
  Cas9 variant
augaagcugcggaacgccaaagacuacagcaucggccucgacguggggaccggcuccaccgggugggccgucacgacccuugacggcgaccuguucaccuucaaccaccgacccacccucgggagccgucuguucgaguccgcgagcacggcccaggagacccgggaggcgcgcggcgcccggcgccggcugaagcgccggcgcuggcggaucucccuccugcaggagcaguucgccgcggagauggagagcugcgacuccaacuucuucauccgccugaaccagucccggcucuggcaggaggaucgcaccgagcagggcaagggguaccuguucggcgggaagccuauccugugcggcgcacaaaucuucgccaacgaacaggaguacuaccaacaguuccccaccaucuuccaccuccggaaguuccuaguggagugcuccgagcaggucgaccugcgccucaucuaccuggcccugcacaacaucgugaaguaccggggaaacuuccucuaccaggacaauaagacgcugaacgugcgcaacuucaaucuggacagccagauagcggacuuccucgaccagcugcagcuguggugcgagaacaacgaccucugcuuccacgagaucgacggcaccaccacccuggccucccagcugaacacgugcuuccaccagcaaagcaaccagcaaaagaaggacacccucaagaccuucuucgcgacgugcaucgagaacgacaagaucgccggcgagcugacgaaggcacugcucggguacaagaccgacuucaagaucaucuuuaacaucgaaggagagaaggacgaguacaaggccaagugcaacgaggaggagaagauccugaagcugcaggagaccaucgaugacgccaaccagguccuccugcaguccauccugaaccucuacagcgggaucaucgucgagaagauccugaacaacaccgccgugaagaacgaguccgcccagugcacguugagcgccuaccacugcuacuccuacgcgcucuacagcaagcagcuccggacccugaagaagcucgugcgcaaguacaacccccagcgguauaacgagugcuucaaccuguccgccgaggaccccaaggccaagaagcagcugugcaccuacgcccgcuacaacgcccagcacagcaccgacuacgacgaguucaagaaguacaucaaggaccucuucgagaacacggaugcggucaacgacgccgccuaccagcagaugaagcaggacuucgacgaggagaaguuccugcgccggcagaagaccagcgacaacggcguguacccguaccaguuccaccuggaggagaugcagcucaucaucgagaaccaggcccagcauuacccuuuccugaccaagauaaagcccaagcuggagucccuggugaccuuccgcaucccauacuacgucggcccgcucacgcagaaggggauccagcggaacggccgcaaguucgccuggagcaagcggaacaaggacgcggagaaccagcgcauuuaccccuggaacugggacuccauaaucgacaagagcgccuccgccgaggcguucauccugcggaugaccgggaagugcaccuaccuguacggcgaggacgugcuccccaaggagagccugcuguaccaggaguucugcgugcucaacgagcugaacggggcgcgcuggaacugcgacggcgagcgccgcaugccccuguccaacaaggacugcaaggccaucuaccggcagcuguuccuaaagaagcagaaggucagcuacgccgauguguccaacuaccugaaggcccagggccacaucaacaacagcguugccgggggccagggggagcacggcuucgaguccacccucagcucccaccacuucuuccgcaagcuguucaacgucgacgcugccaacgaccugacggcgcagcagaucgagaccgccgagcagcucauccuaugggggaccaucuucgaggacaaggagaucuucgagcagaagaucaaggagcgguucggcgacauguucagcaaggacgagaucaagaccaucgcccgccggaaguucuccgguugggggaagugcagcaagcagcugcucuccggccugacgguggagaccccgcgcgggcgggagagcaucaucgacgugcugcgcaacggccaccccgagaacgggcgcacccucgucuucaugcaggucaucaccgacaagaagcuggaguucgacaagaagaucgaggaguacaacaacgagcaccuggcgaagaccaacgagucagugcucgacacggccaucaugagccccgccauuaagcgcggcgugaaccaggcccugcacaucgugggcgagauccgccggaucacuaagcacgacccgaccugcaucuacaucgagaccacgcgcgacgagaaggacgguaagcacaacacccggaccagcucccgcuacagcucccugaagaagaaccucgagacccucaagagcaucgacaaggccaacgcgcccgccaucaagcacucccuggagcuccuggagacguacaagaagcagaacaucgacgacaaguuauuccucuacuucacccagaacggcaaguguauguacagcgggaagucccuggacaucaacaaccugagcuccuaccagaucgaccacgucaucccccagagcuacaucaccgacaacuccuucgacaaccgggugcuuguguaugccagcgagaaccagcgcaaguccgauagccugcugcucuccagcgucauccaggccaagcaggagcccuucuggaccucccuggagaaggcaggccugaucagcgagaagaagcacaacaaucucaagcgcaagagccuguccgacgcccagaucaagggcuucaucaaccggcagcuggucgagacuagccagaucgugaagguccuccgggacgagcugucccgcauucugcccgacaccaagaucaucccggugaaggccagccucucccaugacgugcggaucgccugcaaccuguacaagagccgcaccgccaacuccuuccaccacgcgcacgacgcacugcucgccagcaccauggggcgguucguccagacgcgcuuccccgacauguacgagaaccccgugcgguacgugaagauccugcgcgccuacaucgcccaguccaagcugcagcacagcgcgcagacacguaacuucgacucccgcagcuucauggcccacuccuucuucugcgacuacagcaacgagaacggcgauaccaucuggaacuccgccagcgagaucgagcggcuccgccgggcucuguccuacaagaaucuguaccucacccgccgccccuucaucgacgccgggcaguucugggaccagaccaucuacagcccgcacgacaagaagaagacccccgauucccugaucccccugaagaagaaccucgacacccaaaaguacggcggguacagcggcaaggacuacgcgcacuucuucaucuacuccguccugaacaagcagggcgacguugaguaccgguucgacggggugccccuguacaucgccgccaacaucaaccgcgacgaccggggcgcccucgcgcaguaugccaagcagcuggucgagcacgagaacgugccgaacgccaagcgcaagaccaaggaccugguguuccagcggaucgagcgcgccugcguccccaaguaccagcucaucugcaucucccagugcagcggggacuccgaccggagcguguccgauuacuauuacaucacgggcaagaaggagguccgcaacgcucugcagcuggcguuccccaugcaccucuacggggccaucaacgccaucgaggacaagaaggagcuggacgacagcgcacuggaggaacucgucguguacaucuuacggaacgccccgcgcaucgcgcccgacguguuccggcgccugaaucucaccgagaagcuggccgacugccuggacauccccgaucggaucgagcuccagaacuccaucuacggccuguucaaccugaucaacgccgagagcaacgucgugaaccuccagaucuucggcggggccaagaccgccggcgugaagcugaucaaccugaacucccuccugaacgaccccgcgaccacggucaccuucaucgaccagagcgugaccgggauguucgagcgcaaggaaaccaucggcaucuccuga

SEQ ID NO: 7936 - RNA, 4209 nt, Artificial Sequence; identical to SEQ ID NO: 2136
  Cas9 variant

SEQ ID NO: 7937 - RNA, 4209 nt, Artificial Sequence
  Cas9 variant
augaccuaccguaacuaccacaucggccuggacaucgggaccucauccgugggcuucgccgugcgguacgacaacggggagcucgugcacaagaagggcagcaaccuggugggggcccgccuguucaaggagggcgagacggcggaggagagacgccucaaccggggcgcccgccggcgcuacaaccggcgcaaguggcggcugaaccugcucaaccagaucuucaagccccugaucgaggucaacgacccgaccuucuucaagcgccuggagcaguccaaccucguaaacuacgacaagagcgaguccuucagccugcuaaacaaccaguccgacgacaaacuccaccagcaguuccccaccaucuaccaccuccgggacuaccugaugaagaguaccgagaaggccgacauccgccucaucuaccuggccgugcaccacaucgucaaauaccgggggaacuuccuggacgccagccccguggauagcuucgaggcguccaaccucaagguggacgagauccugacgcagaucaaccugcuccuggacaaccugaccgacgaccuccgccuuaacacccaguacgucacggacaucgagcagacgcugcucagcaauaccgaguccaacaaggacaaggagaaggugauccagaagcugcugcuccacaaggaggccaucaagaucgacaaggaccggacggcccagaucgccaagcuggugcugggcuacaaggcggacaucgccaagcuguucgggaucaccgagaaacuucagacgcccaagcuggagcucagcgccgccaacuccgacgacgcucugauggaacugagcgcggagcucaacgaggaccagaucggcaucuugcugcagcucaagacccuauacucccgcguccggcugaaccagaucauccccagcgggaccuccuuaagcaagagcaugaucgagaaguacgagcugcaccacacccagcugaaguccuucaaggagaacauccuccugaagcugcgccggaacacggccgugcgccgcaaccuggagcucgccuacgcccuguacgugggcaacgcccaaaccaagcaggaggucuucgagcccaagaaggcucgguucaccagcgacgacuucgccucccugaaggccaacgccaagagcgccuccagcgugaaggaggcgcccaagaacaccaagacgaagcucaccaccgacgacuucuacaacauccugaccgagcuguucgcuacguucgaguccgagcucagcgccgacgaggacaugaucaaggagguggagcagaucaagaaggccaucaccggggacaacuaccuacccaagcaacgcaccgaccagaacgggaacaucccgcaccagcugcaccaaaucgagcuccggcagauccugcagaaccagcugccccauuaccccgaaauggacaagaucaacgagcagaagcccaucgagaagcucgucacuuuccgcgugccguacuacaucggcccccugaucacgcccgaggaccagcagaaguccagcgccgcgaacuucgccuggaugaagcggaaggagcagggggcuaucaccccguggaacuucgacgacaagguggaccgcaugcaguccgccaccaacuucaucaagcggaugaccgucaaggacacguaccugaucaacgaggacgugcucccggaccgcagccugcuguaccagcgguucaaggugcucaacgagcugaaccuggucaaggugaacaaccagcuccuguccaucggcgagaagcaggcgauauaccacgaccuguucgagaaacagaaaaccgucagcaccaagaagcuccaguccuaccugcagagcgagcagggcuacggggacaacaucgagaucuccggacugagcaaccccgacaaguucaacaacgggcucacgacguacaucgacuucaagaacaucuucggcgaccugguggaggacaccaccaagcagaaggaguucgagcagaucaucgagugguccaccguguucgaggaccgcgccaucuucaaggccaagcugcaggaggucaacuggcucaccgaggagcagauuaaggcccugguggccaagcgguacagcggguggggccgccugagcuacaggcuccuggcggaauuggugaacgacaacggcgagcgcaucaucgacauccucuggaacaacaagggguccaaccugaugagcauugucucacaggacgaguuccagcagcagaucgcccggaucaacagccaugaggugcaggagcugggcauggaguccgugcucgcaaacgccuacacgagcccccagaacaagaaggccauucgccaggucaugaaggugguggacgacauccagcuggcgaugaacgggcaggcccccaccuccaucagcaucgaguucacccggaagccggaggagaacuccgagaucagcaagucgcgcuacgagaccaucacgagcaucuaccagucccugagcaaggacaucgagaaggaggucaaggacaaccucaacaagaacaaguccagcuuaaagaagaaccuguccgacaaguacuaccucuacuucacccagcugggccgggauaucuacaccaaccagcccauccccuucaacgagauccccuacuaugacaucgaccacaucgugccgcgcuccguggagaugaacgacagccugaacaaccgcguccucguggccaaaaguaucaaccagaucaagaagaacaacgcccccaucgacagcucccugaagauuaccagcgagacgcggcagcuguggaagaagcuccuggacuccgggcugaucaccaagcagaaguacuacaagcucagcuccagcaucaagaacaccgugucccccuacgucaagcagggcuucaucaaccgacagcugguggagaccagccaggugaucaaacuggucgccaacauccucggcacgaaguaccagaacgacgacaccgagaucaucgaggugaaggcgcaccugaacuccgagauccggaagaccuucgaguucuacaagcugcgcgagcugaacgacuaccaccacggguucgacgccuaccugaccacgcuggucggcggguaccucuacaaccgguaucccaagcuacgcagcuacuucgucuacggcgaccacaagagacuggacaaggcccagcucuccgagcugaagaacuucaacuuccugcacgggcucaccaaccccaagagcggcuccgacggccugaucaccgccagcgggagccagcaggucgugcuggaccgcaacgagaccaucaagcgacucaacaagaucuaccgcuacaaguacaugcugaucagccgggagguguucacgaagcagggccaguucuacaacgagaccaucuacccggcgaagcccaacaccgcuaagaugaucccguuaaaggacaacaaacccuccgagguguacgggggcuacagcagcuccaacgugucgaagaucgcccucaucaaggagaagaacaccgacaacuaccaguucaucggcauccccauccgcuccaucgccaagcugaagcaggccaaggcgaacagcaagacggucuaccagaccgagcugaaccgggugaucaaguccgugcucgccucccagaagaccaagaaacaaaaggaguucgaagucauccuggauaacgucaaguacaaccagguggucguggaccagggggagaaguacuaccugggcucccccuacuacaagaagaacgccaagcagcucgugaucagcccggaguccgucaagauccuggccgacaaggccaccgcggaccugcccgagcaggaggcccacaauaagcucaugacgguguaccaggagaucguggacguccugaacaagcacuucgcccuguacgacaucaacaacguacgcaagaagcucaacgacgggcugaucaaguucagccagcugcccaacuacgacgagaccuccaagaaccgguucgacaucagcaaguccaucaagaccaaguacgccgugaucaugcgcauacucagcggcaucaagaaccagaccuccgagguccccgagcuggggcucaagagcccgcugaacaagaugcagacgaagggcggcaucaagaucucccccgaggccaaaaucuacuacucaucccccacugggaucuucagccacuucaagcaggucaagaaccuguga

SEQ ID NO: 7938 - RNA, 4209 nt, Artificial Sequence
  Cas9 variant
auggaacgcauccugggacucgaccuuggagugagcuccaucggcugggcccuggucgaggaggacgugaagaaucccgagaacaacaaaaucaucaagcucggugugagagucaacccgcugaccaucgacgagaaaacuaacuucgagaagggcaagagcaucacgaccaacgccgggcgcaccuccgcgcggagcgcccgccggaaccuccagcgcuucaagcuccgccgcaagaagcugcuggagauccucauccacuacaagauaaucaaaaaugacgccgugcuggccgagaccggcaagaacacgaccuuccagacccaauaucugcgggcuaaggcggcccgcgagaagaucgagcucgacgagcuggcccgaguguugcuccugaucaacaagaaacgcgguuacaagucuagccggaagguccagaacgacgacgacgggaaggccaucgacggccuguccguagcgaaagagcuuuacgagaagaacuacacccccgggcaguacgccuacgaccugcugaaacgcgggaaaaagcagauucccgacuucuaccggagcgaccugcagaacgaguuagaccgcaucugggaguuccagaagcaguaccaccccgacauccugacggacgaguucaagaaggagcucgaggguaagggccagagggccaccgccgccaucuuccucaaccgauacaagaucuacaccgcggacaacaaggguaccagagaggaaaagaagauccaggccuaccaguggcgcguggaggcccugagucagccgcucgacgucaaggagguggccuacguaaucgccgagaucaacaacaaccucaacaauagcuccgguuaccugggcgcgaucagcgaccgguccaagaagcucuacuucaacgggcagacgauaggcgaguaccuguucgaggagcugagcgccaacccccacacacggcucaagaaccaggucuucuaccgccaggacuaucaggacgaguucgaaaagaucuggaaaauccagacaaaguuccacccagagcugaccaaggagcugaaggaacaggugcgggacauugugaucuucuaccagcgcaagcucaagucccagaagggccugaucagcuucugcgaguucgagagccgggagaucgagaucgaggagaacgggaagcgcaagcggaagaaggugggccugaagguggcccccaagagcuccccgcuguuccaggaguucaagauuuggcagguccucaacaacaucgagaucaagaacgaggacgagcgccgguaucuggagcccgaggaaaaagagcucuuguucaacgagcugaacugcaaggggaaccucacgagccagaagugccuggagcugcucggcuucaagagcaaagacgccaagcugaacuucaaggugguggagggcaaccgcacaaacgagaaguuauacgacgcguuucugaagauccucgagcugcagggcuacaacguguucgaacuucucaagaucaaggaggacaaggaugaagcgaagcugucggaguuaaaggccagcgccgacgagauaaaggguaugaucaaagagaucuucaacgcuaaccucaucaacaccuccauccuugacuucaacgccgagcuggaggggaaggacuucgagaaccaggcgagcuaucaguucuggcaccugauguacuccuacgagggcgauaacucacccucagggaacgagaagcuguacgagcugcuagagaaaaaguucggcuucaagaaggaacacaguaagauccuguccaccauugucuucucgcaggaguacgggucccuaagcacgaaggccaugcggcgcaucuaccccuauauaaaagacaacaaguacuccgaggcuugucuccuggccggcuacaaccacagcaaacacucccugaccaaagaggagcucgagaaccggaaauuaaaggagcagcuggagguucucccgaagaacagucugaggaaccccguggucgagaagauccugaaccagaugaucaacuuggucaacgcgaccaucuccgaauacggcaagcuggacgggguccggaucgagcuggcccgcgaacucaagaaguccgcccaggaacgugaggacauggccaaaucaaucaacgaggccacccuccugcaucagaaguacgcgacaauccucaagcaggaguucggcguggugaaucccagccgcaacgacaucauacgguacaagcuguacauggagcugaccgucaacggguacaaagaucuuuacaccaacaccaagaucgagaaggagaaccuguucacggacaaguacgacauugaccacaucaucccgcagagucgcuucuucgacgacagcuucagcaacaaggugcuggucccccgucaguccaaccucgacaagggcaaccugaccgccuacgacuucaugagcaacaaagggucagaacgcgaggagcacuuccugaacgucaucaaggagcuccuggauaagggaagcaucuccaaggccaaguacgagaaacugaaaaagaaaggccucgagaucggggacggcuucaucgagcgcgaccugcgcgacacccaguacaucgccaagaaggccaaggaaauccuguucgagaucaccaacagcguggugacgacauccgggcgcaucaccgauaagcuccggaaggauugggaccuggucaacaucaugaaagagcugaaccucgacaacuacaggcggcugggccugaccgagaucgugcgcaacagcaagggcgaggagaaggagcucauccccgacuggacgaagagaaacgaccaccgucaccacgcuauggacgcacugaccguggccuuuaccacccggaaccacauccaguaccugaacuaccucaacgcucgcaaggacgagaagcacaaggagcaccagaacaucuacgccaucgagaauaucaucaccgaggucaucgagaagaagaacggguccaagacucgacgcuucaaggcgcccaugaacucauuccgucacgaggccaagcagcaccugaaggagauccuggugucccacaagaccaaaaauaagguggucaccaguaauaucaacaagaccaagaagaaaggcgggauccacaagaagacggagcucacgccccgcggccagcugcacaaggagaccguguacggguccaagaaguuccugcagagccgggaggagaagguguccgccaaguucgacuacgagacuauccucauggucguaaaccccauacaccgcaacgcgcuccugaaccggcucaaggaguacggcaacgacccgaaaaaggcguucagcggcaagaaugccaucaauaagaaccccguguaccuggaugacagcaagaccgacauccuguccgagaaaguuacccucagcugguacgagaccggguacacgauccgcaaguccgugacacccgacaacuucaaggacuacaaaaaccuggaaaagaucaccgaccugggcaucaagaagauucucaaggagcggcuggaccaguuuaaggggaacgcaaaggaggccuucaguaaccuggauaaggacccgaucuggcucaacgaggagaaggguaucgcaaucaagacagugaccaucacaggggucuccaacgcggagucacugcacuucaagaaggaccaccucggcaaggagauccucgacgaaaacggcaacaagauccccggugauuucgugucuaccggcaacaaccaccaccuggccaucuaccucgacgaggaggagaaauuggacgacaagauggugaccuucuaugaggccguccuacgcgugaaccaggggcugcccguaaucgacaaggacuacaacaaggagaagggcuacaaguuccucaugacccugaaacagaacgagauguucgucuuuccgaacgaggacuucgacccgaacgaaauugaucugcucgacgagcggaaccuggagcgcauuagcaaacaccuguuucgagugcagaaaaucuccaaagugggguacggcaacagcuucguccgggacuucguguuccggcaccaccuugagacgaccguggaggagcggaaggagcuacgcaacaucaccuacauccagcugaaaagucucgagggccugcggaacaucaucaagguccgccugaaccaccuagggaaaauugugcagaucggcgaguacuga

SEQ ID NO: 7939 - RNA, 4215 nt, Artificial Sequence
  Cas9 variant
augaccaagaacauccugggccucgaccugggggugagcuccaucggcugggcccugguucaggaggacagcaagaacccggagaacaaccgcaucgugaagcucggggugcgggucaacccgcugaccguggacgagcagaucaacuucgagaaaggcaagcccaucacgaccaacgccucccgcacccuggcgcggagcgcccgccguaaccuccagcgauucaaguuccggcgcgccaaccugaucgacgugcugaagaaaugcaacauccucaagcagggggaucugcugaccgagaucggcaagaacuccacguuccagacccaggagcuccgcgccaagagcgccaaggagaaggucgaguuauccgacuucgugcgcgugcugcuccugaugaacaagaagcgaggcuaccgcagcucccggaaggcgaagaacgaggacgaagggcagaucaucgacggcaugagcgucgccaagaagcuguacgaggagaaccugacccccggggaguacuccuaccagcugcugaucgagaacaagaagcagcuccccgacuucuaccgcagcgaccugcagucugaguucgaccggguguggaaguuccagaagcaguucaauccggagauccugacagacgaccucuacaaggagcugcagggcaagaacaagaacgcgacgugggccguacugaaggaacccuucagccucgucgggauaaagcagaucggcaccauccaggagaagaaggcggagaaguacuucuggcgcuccgaggccgugaagcggcagcuggacuucgaaagccuugccguggucuuccaggagaucaacuccaaccucaacaacagcuccggcuaccugggggccaucagcgaccgcagcaaggagcuguacuucaacaaccagaccgugggcgaguaccucuuccagcagcugaaggagaacucccacaccaagcugaagaaccagguguucuaccggcaggacuaccucgacgaguucgagaagaucugggagacgcagagcaaguacuacaaggagcugaccaaggagcugaaggaggagauccgcgacaucaucaucuucuaccagcggaagcucaagucccagaaggggcugaucagcaucugcgaguuugagaaccgagagauugagaucaccgagaacggcaagaucaagaagaagacggucggccugaagguggcacccaaguccagcccccucuuccaagaguucaaaaucuggcagguccugaacaaccugguguuccaguccaucgagagcaaggagcuguucccgcuggaccuggacaucaaggaguccaucuucaacgaggugaacaucaaggggaaccucuccgcgaagaacgugcuggaccugaugggcuacuccgggaaggaguggaagacgaacuucaagaacaucgagggcaaccgcaccaaugagaaucuguacaccgccuuccucaagaucaucgccucagaggggaucgaguuccccaaggaguucaagcuguccaucgacgacgacaucaagguaagcaagaucgacaucuccagcgagaagaucaaggaguucaucaaggagaacuuccugaagcucggcaucaacaccuccauccuggacuucaaccccgagcuggacggcaaggacuucgagaagcaggagagcuaccagcucuggcaccuccuguacuccuacgagggggacgacagcgccagcggcaacgugaagcucuacgagcugcuggagaagaaguucggguucaagaaggagcacuccaagauccucgccgacgucggcuucagccccgacuacgggucccugucguccaaggcgaugcggaagaucuacccguacaucaaggagaacaaguacagcgacgccugccaccuggccggcuacaaccacuccaagaacagcuucacuaaggaccagcucgccaaccgcauccugaaggagcagcuggaaauccuccccaagaacgcccugcggaaccccgugguggagaagauccugaaccagaugaucaaccucgucaacgaggugaucaaggcguacggcaagcccgacgagauccgcaucgagcuggcccgggagcugaagaagaacgccgaggagcgcgccaacaugaccuccgacaucagcaaggccacccuccugcaccagaaguacgcggaggugcugcagaaggaguucgggaucaaggccccgucgagaaacgacaucauccgcuacaagcucuaccuggaacuggagaagaaccuuuucaaggaccuguacaccgacguccagaucaagcgagaggagcuguucacggacaaguacgacauagaccauaucaucccccagagccgcuucuucgacgacuccuucagcaacaaggugcucgugccccggggcgccaaccugaagaaagggaacuucaccgccuuagacuacauggagaucgagggcaaggagaaguuagagaaguuccugaacaucaucaaggagcuguucgacaagggggcgaucuccaaggccaaguucgagaagcuccagaagaagggaagcgagaucggcgagggguucaucgagcgcgaccugagggacacccaguacaucgcgaagaaggccaaggaaauccuguucggcaucaccaacuccgucaucagcacgagcgggcgaaucaccgacaagcuccgggaggacuggaaccuggugaacaccaugaaggagcugaaccucgagaaguaucgcaagcucggccugaccgagcucaucgugaacucuaagggcgaggagaaggagcggaucaucgacuggacgaagcgcaacgaccaucggcaccacgcgauggacgcgcugaccgucgcguucaccacccacaaccacauccaguaccugaacuaucucaacgcccgcaaggacgagaagcacaaggagcaccagaacaucuucgccaucgagaacacgaucaccgaaaucguggagaagaagaacgggagcaaggagcgccgguucaagcugcccaucaagaacuuccgcaccgaggcaaagaagcagcuggaggaggugcucaucucccacaaggcgaagaacaaggucgucaccaagaacaucaacaagauuaagaagaaggggagcaucaucgcuaagaccgagcugacgccgcgggggcagcugcacaaagagaccaucuacggcuccagcaaguuccucaagaccaaggaggagaagaucuccgggaaguucgaccuggagaugauccagaaggugcagaacgaaaaguaccgaaacgcccugcucaagcgccugcaggaguucggcggcgacagcaagaaggccuucacggggaagaacgucaucuccaagaaccccaucuuccugaacgccgagaagacggagcagcuccccgagaccgugacccuggcuugguacgagaccggauacacgauccgcaagguggucaaccccgacaacuucaaggacuucaagaacaucgagaaggugaucgacaagggggugcgggacauccugaccgagcgccucaaggaguucaacggcaacagcaaggaggccuucuccaaccuggagaagaacccgaucuggcugaacaagagcaaggggaucuccauaaagaccgucaccaucacgggcaucaacaacgccgaggcccuccacuacaagaaggaucaccugggcaaggagauccuggacgagaacgggcagcggaucgcgguggacuucgucagcaccggcaacaaccaccacgucgccaucuacgaggacgacaacgggaaccuccaggagaaggugguguccuucuacgaggccgucgaacgcgugaaccagaaccugccgaucaucaacaaggaguacaacuucgagcuaggcuggaaguuccucuucaccaugaagcagaacgagauguuccuguuccccagcgacgacuucgaccccaaggagguggaccuguucgacgacaaguaccucucccugaucagcaagaaccuguuccggguccaguccaucagcaucgugcaguacgggaacucggugauccgcgacuucaaauuccggcaccaccucgagaccuccgucagcgacgagaagaaacugcagggcgugacguaccagcagaucaagucccugcaaccgcucaaggacaucaucaagauccgccugaacaaccugggcaagaucgugcagaucggggaguacuga

SEQ ID NO: 7940 - RNA, 4215 nt, Artificial Sequence; identical to SEQ ID NO: 2140
  Cas9 variant

SEQ ID NO: 7941 - RNA, 4215 nt, Artificial Sequence; identical to SEQ ID NO: 2141
  Cas9 variant

SEQ ID NO: 7942 - RNA, 4215 nt, Artificial Sequence
  Cas9 variant
augagcaagaagauccugggccucgacuuggggaccaccuccaucggcugggccuucgugagagaggccgaggacuuccaggaggagagcaguaucgaacggauagggguccgugugaacccccugacgaccgacgagcagaucaacuucgagaagggcaagccgauuagcgugaacgcggaccggacccucaagcgcggggcccggcgcaacuuacagcgguacaagcagcgccggaccaaccugauccagcugcugaagcaguacaagaucaucaacgagaacacaauccuugccgaggacgauaagaacacaacccauuccacguacgcccuccgcgccaaggcggucuccgagaagaucuccaaggaggccuuugcccgggucuuguuaaugauuaacaaaaagaggggcuacaagagcucccggaaggccaagaacgaggacgagggccaggcgaucgacgggaugagcguggccaagcgccucuacgaggaggacaucacgcccggccagcugugccugcaguuacugaaggaggggaagaagaagcugcccgacuucuacuuauccgaccugcaggccgagcuggagaagaucuggaacuuccaaaagaaauucuaccccgagauccucaccgacgaguucaagaaggagaucgaggggaagggacagcgugcuaccagcgccuccuucugggcgaaguacaaguucaauaccgccgagaacaagggcagccgugacgagaagaagaugcaggccugggaguggcguagcaaggccaucaauacucagcugacccgcgaggaggucgccuacgugaucaccgagaucaacaacaacaucaacaacagcuccggguaccugggggcgaucagcgaccgguccaaggagcucuacuucaauaaggagaccgugggcgaguaccuguuccgccagcugcgguacagcccgcacacccgggucaagaaccaaguguucuaccgccaggacuaccucgacgaguucgagaccaucugggagaaccagagccgguaccacaacgagcugaccaacgagcugaaauccgagauccgcgacguggucaucuucuaucagcgcaagcucaagagccagaaggggcugaucuccuucugcgaguuugagagcaagcagauagagauccagaaggacggcaagaucgugaagaagaucaucggccuaaagguauccccuaagagcagcccccucuuccaagaguucaagaucuggcagauccugcaaaaucuggaguucaccaacaaggagacgaaggaaaagaaggugcccgacuucgaggccaagaaccuccuguucgaggagcugaacaucaaggggaaccucaaaggcgagaaggccaucgagaucuuaggguacaagccaaaggaguggcuggugaacuauaaggagcucgacggcaaccgcacuaaccaagugcuguacgaaggauaccugaagauccucgaggucgagggcuacgacauuaaggaccugcugaagaucaaguccaacaaggacgaggugaaccucuccgagcugagcaagcccguguccgagaucaaggaccugauaaagagcaucuucgagucccugaacaucaacaccgccauccuugacuucaaccccgagcuggaaggcaaggacuucgaacggcaggcaucuuaccaacuguggcaccuccucuacuccuacgagggggacaacagcaacacuggcaacgacgagcuguacagacuccuguaucaaaaguucggguucggcaaggagcacgcgcagauccucgccaaccucuccuuuagccaggacuacgggucacugagcgccaaggccaugcggaagaucuaccccuucaucaaagagaacagcuauuccgaggcgugcagucuggcgggcuacaaccacuccagcucuaucacgaaggaggagaacgacaaacgcgagcucaaggagaagcuggagcugcucccgaagaacagccugcggaauccggucguggagaagauccugaaccagauggucaacguuaucaacgccaucaucgccgacccgucgaugggccgccccgacgagauuaggaucgagcucgcccgcgagcugaagaagaacgcggccgagcgggccgagaugaccauccacaucaacaaggccaagagcgagcacgacaacuaccgcaagauccugaccaccgaguucgggaucccgaaccccacgcggaacgacaucauccgcuacaaacuuuacgaggagcugaaggugaacggcuacaagacccuguacuccaacaccuacauccccagggagaagcuguucagcaaggaguucgacgucgaacacauaauccccaaggcccucuuauucgacgacuccuuuagcaacaagacgaucugcgcgcgccaagagaaccucgacaaggggaacaagacggccuucgacuucauccaguccuuuuauggcaaggagaaguuugaggaguaccugcagcgcaucgagagccuggccaagaucaaggagggggacaccuucgugaucuccaaggccaaguacaagaagcuccugcugccggagaucgagaucggcgagggcuucaucgagcgcgaccuccgcaauagccaguacaucgccaagaaggcgaaauccaugcugcuggacauaugcaagaccgugguccccaccacggggagcauuacggaccggcucagagaagacuggggccugaucaacaucaugcaggaguuaaacuucgagaaguacaagaagcucgggcugaucgagaugguagagaaaaaggacggcagcuucaaagagaggaucaccgacuggacuaagcgcaaugaccaccgucaccacgccauggacgcccugacuguggccuucacgaagcauaaucacauccaguaccucaacuaccugaacgcccgcaagaacgagaaccacaaaaugcacggcaacgucaucgcaaucgagcagaaggagaccgagcugcugguggauuccguggggaagcggaagcgcaaguucaagcugcccaucagcaauuuccgggaggucgccaagaugcaccuggaaaacauauuaguguccuacaaggcgaagaacaagguggcaaccaagaacaagaaccgauucaagaccaagaacggcgagaagguuaagaucgagcugacuccccgggggcagcugcacaaggagaccguguacggcaagaugaagaaguacgaaaccaaggaggagaucaucgggagcaaguucgacgaggccaccauccucaaggucgccaaccuggagcagcgcaacgcccugcuacagcggcugaaggagaacaacaacgacccuaaaaaggcauuuuccggcaagaacagccugaaguccaacccccuguacuacggcgucgacagcaagccaauccccgagcgcaucaagaucguguggcuggaagacgacuacacgauccggaaggagaucaccccggaccugaagaucgacaagguaauugacaucgggauccgccggauccucgagaaccgccuggccgaguucaacggcaacgcgaaggaagccuucuccaaccuggaaaagaaccccaucuggcucaacgaggggaagcggaucgccaucaagcgugucacaaucagcggcgugaagaacgccgagacccugcacuacaagaaggaccaccuggggcacgagaugcucgacaagcaaggcaagcggauccccguggacuucgucucaacgggcaacaaccaccacguggccaucuacaaggacgacaagagcgaccugcaggaaaaaguggucucuuucuacgaggcgguggagcgcaucaaccaggagcugccgaucaucgacaagucauucaaccacgaccucggguggcaguuucuguucaccaugaagcagaacgaguacuuuguguucccccgcgacggcuucgaccccuacgagaucgaccugcucaaccccgacaacuacaagaucauauccccgaaucuguucagaguccaaaagaucgccacuaaaaacuacguguucaaccaccaccuggagaccaaggccguggacggggagcuccugaagacgaaaaaggaccugagcgacaucacauacagguucauccagacccccgucaaccucaagaacaucauaaaggugcggaucaaccacaucggccagaucgugaagaucggggaguacuga

SEQ ID NO: 7943 - RNA, 4218 nt, Artificial Sequence
  Cas9 variant
augaagaccauccugggccucgacuuagggaccaauucaaucggcugggcccuggugaaggaggccgagaacuccaacgagaaguccgagaucaucaagcucggagugcgcgugaacccacugacgguggacgagaagaccaacuucgaggcgggacggccgcugucgaccaacgccgaccgcaccgccaagcggagcgcccgccggaaccuccagcgcuacaagcugcggcgcaagaaucugaucgaccuccugaucaagaaccagcucauugacaaggacacgccccucaccgagaucgggaagaacaccacccaccagacgcuggagcugcgggccaaggcggcucgcgagcggaucgagcucgaggaccuggcccgcgucuuccuggccaucaacaagaagcggggcuaucggagcucacggaaggugaacaacgaagaagagggucaggcgguggaugggauggccgucgccaagaaguuauacgacgagaaccugacccccggccaguacgccuacgaguuguuguccaaagggaagaaguacgugcccgacuuuuaccgcagcgaccugcaggccgaguucaacgcgaucugggaguaccagaaacaguucuaugccgacauccuggacgacgagcucuacaacgcccugaagggccaggggcagcagaacucccggaagcgcuuucuggccaucaagggcguguacaccgccgagaacaagggcaagcgggacgacgucaagcuccgccacuacaaguggcggagcgaggcgaucuccaagaagauaaacauugaggagguugccuacguguuagucgagaucaacaacgaccugaacaagagcuccggguaccucggcgccaucagugaccgcuccaaagaacuuuacuucaacaaggagaccgugggggagaaccuguggaagcagauccagaagaacccgcauaccagccuuaagaaccagguguucuaccgccaggacuaucuggacgaguucgagcagaucugggaaacccaggcccaauuucacccccagcuaacccucgcccugaaggagcagauccgggacgucaucaucuucuaccagcgaaagcugaagucccagaagggccuccugagcuucugccaguucgaguccugggagaucgagcggaaggacgagaacggcaaugugauucugaacaagacgacgcagcuccccaagcgacaaaccguggggcgacgcgucgcgcccaaaagcagcccgcuguuccaggaguucaagaucuggcagaacaucaacaacuuagaagugaccaagaucuccgagggcgcaucgaagaacaagaaggagacggagacgcucuccgacgacgagcggaagcugcuguucgaggagcucaaccugcgcgggaacuugucucagaaggaaguucugcagauccucggccugaaggacaaggaguacaagacgaacuucuccgaagggcuggagggcaaccggaccaacgcggcccucuucaacaucuaccagcagaucgccgagaaugaaggcuacggguucgacuggagcaagaaguccgcgcaggagaucaaggaggagcugaaggccgucuucccccagaucggcauccaagccgacauccuggacuucaacgcuaaccucgacgggaaggaguucgagaaccaggcgagcuaccagcuguggcaccuccuguacuccgccgaggaggacgacaagaucaacgaagaggaccaaaucaucuacggcaacagcgcgguaucccugaagaagaagcugugcgagaaguucggguucacccccgaguacgcuaaguggaucgccaacgugagccuccaggacgacuacggcaaccuguccacgaaggcgaugcgcaagaucauccccuaccugaucgacggcaacgacuacagcgaggccugcgccuuagccggauacaaccacuccaacagccucaccaaggaggagaacgacaaccgggagcugcucgacaagcuggagcugcucccgaagaacucccugcgcaaccccgucguugagaagauccugaaccagauggucaacguggugaaccaggucaucgagaccuacggcaagcccgacgaggugcggaucgagcucgcccgcgagcugaagaaguccgcggaaaagcgggccgagaugaccaagagcaucaacgaggccacgcgccggaacgaggacaucaagaagcugaucaccaaggacuucgggauccccaacccgacaaagagcgacgugguccgcuaccgucucugggaggaacuggcgccccuggccuacaaggauguguucacaggaaagcagaucaagaaggaagaccucuucagcuccaagaucgacaucgagcauaucauccccaaggcccugcuguucgacgacagcuucuccaacaagacgcucgucuuccgcgagaccaaccugaaaaaggccgaccgcaccgccuacgacuucaucgagagcgacuacaacgccacccuggaugacuauauccagcgggucgagacgcucuauaacaauaccaagggcaccaucuccaagggcaagcgcaacaaguugcugauggcgcagaagaaccucccugacggcuucaucgagcgggaccugcgcaacagccaguacauugccaagaaggccaaggccaugcuguaccagguguuuaaggacgugaacgucacauccggaagcaucaccgaccggcuccgcgaggacugggaccugaucaacgugaugaaggagcugaacuucccgaaauacaaggcccucggauugacugaaaucgaggagcgguacgacauagggcaggaaaagaccaagcgcgucgaggucaucacggauuggaccaagcggaacgaccaccgccaccacgcgaugaacgcacugacgguggccuucaccaccuccagccacauccaguaccucaacuaccugaacgcucggaagaaugagucacacaaggagcacaagaacaucaagggcaucgagaacaagaucacccacaagcagaaggacaagcgcaaguucaucccgcccaugcccaacuuccgggaggaggccaagaagcauaucgagacgauccuggugagcaucaagaacaagaacaaggucuacaccaagaauauaaacaagaccaagaagaaguccggccacaacaccaaggagcagcucacgccccgcgggcagcugcacaaggagaccguguacggcaagagcaaacgccccaugagcaaacccaccaagaucaacaagaauuucagccuggagcaagcacagcucaucaucaacgugcaggagaaggagcugguccuccgccacuuagcccaguucgacaacaaccccgccgucgcguuugacaccaagacgcuuaagaagaugccucugcucaagaacggggagccccugaaggaggugcuaugcuucgaggaaauuuucacaauccggaaggacaucacccccgaccucaagauagagaaggucgucgacgaaaagaucaaggccauccuggagcagcgcaagaaggacuucggcgggaacgcgaaggaggccuucuccgaccuggacaagaacccgaucuggcucaacaagaagaagggcaucugcaucaagcgugugaccaucacgggcgugucaaacgccgaggcccugcaccaccagaaggaccaccuggggcgcgagauccucgacgacaacggcaaccccauccccgcggacuucgugagcacugggaacaaucaccaccuggcuguguaccuggacuccgaggggaagcuccaggacaacaucgucucguucuacgaggccguggugcggacuucccaggggcugcccgucguggacaagggccugaacaaggaccucggauggaaguuccuguucucacugaagcagaacgagauguucguguucccgaacgacgacuucgacaucaacgacuucgaucuccuggacgacaagaaagccgaguugaucuccaagcaucucuacagaguccagaagaucagcaagguauccgcggggaacagcuucgugcgcgacaucguauuccggcaccaucuggagacaacggugaaggaggugaaggagcugaaggacaucuccuauauccaacucaagucccuggagggccuccgcaacaucaagaaaguccggaucaaccacaucgggaagaucguccaggugggcgaguacuga

SEQ ID NO: 7944 - RNA, 4221 nt, Artificial Sequence; identical to SEQ ID NO: 2144
  Cas9 variant

SEQ ID NO: 7945 - RNA, 4224 nt, Artificial Sequence; identical to SEQ ID NO: 2145
  Cas9 variant

SEQ ID NO: 7946 - RNA, 4227 nt, Artificial Sequence; identical to SEQ ID NO: 2146
  Cas9 variant

SEQ ID NO: 7947 - RNA, 4230 nt, Artificial Sequence
  Cas9 variant
augagcaucaucaacuuccagcgccggggccugauggagacucaggccuccaaccagcucaucagcagccaccugaaggguuaccccaucaaggacuacuucguaggccuggacaucgggaccagcucggucggcugggccgugacgaacaaggcguacgagcucuugaaguuccgcagccacaagaugugggggucccgccucuucgacgagggcgagagcgcgguggcccggcggggauucagauccaugcggcgccggcuggagcgccggaagcugcgccugaagcuccuggaggagcuuuucgccgacgccauggcgcaggucgacccgaccuucuucaugcggcuccgcgagagcaaguaccacuacgaggacaagaccaccgggcacuccaguaagcacauccuguucaucgacaagaauuacacggaccaggauuacuacaaggccuaucccacgaucuaccaccuccgggccgagcugaugaaggacggaaccgaugacauccgcaagcuguuccuggccgugcaccacauccucaaguaccgggggaauuuccuguacgagggcgcgaccuucgacuccaacgccagcacgcuggacgacgucaucaagcaggcccucgagaacaucaccuucaacugcuucgacugcaacuccgcuaucagcuccaucgggcagaucuuaauggaggccggcaagaccaagagcgacaaggcgaaggccaucgagcaccuggucgacaccuauaucgccacggacaccgucgacaccuccaguaagacccagaaggaccaggugaaggaagacaagaaacgccucaaggccuucgccaaccugguccugggccucaacgcuagccugaucgaccuguucgggucugucgaggagcucgaggaggaccugaagaagcugcagaucacgggcgacacauacgacgacaagcgggacgaguuggccaaggccuggagcgacgaaaucuacaucaucgacgacugcaaguccguguacgacgccaucauccugcugucaauaaaggagcccggccucaccaucuccgagagcaaggucaaggccuucaacaagcacaaggacgaccuggcgauccuaaagucccuccucaagucugaccgcuccaucuacaacaccauguucaagguggacgagaaggggcugcacaacuacgugcacuauaucaagcagggccggacggaggagaccagcugcaaccgcgaggacuucuacaaguauaccaagaaggucguggaggggcugccagacagcaaggacaaagaguacauccugagcgagauagagcugcagacacuccugccgcugcagcgaaucaaggacaacggcgugauccccuaccagcuccacuuggaggagcugaaagucauccuugccaagugcgggcccaaguuccccuuccucaacgaaguggccgacggcuucuccguggccgaaaagcugauaaagaugcucgaguuccggaucccguacuacgucgggccccucaacacgcaccacaacguggacaacggugguuucgccugggcggugcgcaaggccagcggacgggucaccccauggaacuuugacgacaagaucgaccgcgaaaaguccgccgccgcguucaucaagaaccugacgaauaagugcacauacuuacucggcgaggacgugcugcccaaaagcucccugcucuacagugaguucaugcugcugaacgaacucaacaacguccgaauagacgggaagccgcuggagaaggccgugaaggagcaccugaucgaggccguguucaagcaggaccauaagaagaugacgaagaacagaaucgagcaguuccucaaggacaacaacuacauccccgagaagcauaaacccgagaucaccggccuggacggggagaucaagaaugaccuggccuccuaccgggacaugguccgcauccucggcaacaacuucgaccugagcauggccgaggagaucaucaccgacaucaccaucuucggcgagagcaagaaaaugcuccgggagacgcuccgcaacaaguucuccucacggcuggacgaugaggcgaucaagaagcuguccaagcuccgcuaccgggacugggggcgccugagucggaaguuauugaacgugaucgagggaugcgacaaggccggggacggcacucccgagaccaucaucauccugaugcgcaacuucuccuacaaccugauggagcuccugggggacaaguuuucuuucauggagcggauccaagagaucaacgccaagcugaucgaaggccagaucgugaacccgcacgacaucaucgacgacuuagcccucucccccgcggucaagcgcgcgguguggcaagcacugcguaucguggacgagaucguccacaucaagaagacacucccagcccgcaucuucguggaggugacgcgcagcaacaaggccgagaagaagaagaaggacucccggcagaagcgcuuaagcgaucuguacgccgcgaucaagaaggacgacgcccuccuguccggccugaccaacgaagaguucgggggccucaagagcgggcuggccaaguacgacgacgccgcgcugcgguccaagaagcucuaccuguauuacacccagaugggccgcugcgccuacaccggggaggucaucgaccugagccagcucaacaccgacaacuacgacauagaccauaucuacccccggucccucacaaaggacgacagcuucgacaaccugguguuaugcaagcgcaccgccaacgcccagaaguccgacaccuacccgaucagcaaggagauccagaaggcccagaaggcguucuggaucuuccugaagcagcaggggcugaucagcgagcggaaguacgagcgccucacccggaucacgccccugaccgccgacgacuugucgggcuucaucgcccgccagcuuguggagaccaaccagagcgucaaagccgccacaacccugcugcggcgccucuaccccgguguggacguggucuucguuaaggcggagaacgugaccgacuuccggcaugacaacgacuucaucaagguccgcucccucaaccaccaccaccacgccaaggacgccuauuugaacaucguggugggcaacgucuaccacgagcgguucacccgcaacuuucgggcguucuucaagaagaauggcgccaaccgcaccuacaaccucgcgaagauguucaacuacgacgugaacugcacgaacgccaaggacgggaaggccugggacgucaagaccucaauggacaccgucaagaagaugauggcauccaacgacgugcgggucacgaagcgccugcuggagcagagcggcgcgcucgccgacgccacggucuauaaggccgccguggcggagaaggccaaggacggggcuuacaucggcaugaagaccaagucaagcguguucgccgacgucuccaaauacgguggcaugaccaagaucaagaacgccuacagcaucaucguacaguacgcggggaagaagggcgagguggucaaagagaucgugccacugccuaucuaccucaccaaccggaacacgaccgaccaggaccucaucgacuacguggccuccaucaucccccaggcgaaggacaucagcaucaucuaccgcaagcuguguaucaaccagcuggucaaagugaacggcuucuauuacuaccucgggggaaagaccaacuccaaguuuuguaucgacaacgccauccaagugaucguaagcaacgaguggauccccuaccugaaggugcuggaaaaguucaauaacaugcgcaaggacaacaaggaccucaaggcuaacgugaucuccacccgggcgcuggacaacaagcacacgaucgagguccgcaucguggaggagaagaacaucgaguucuucgauuaccuggugagcaagcucaagaugcccaucuaccagaagaugaaggggaacaaagccgccgagcucuccgaaaagggcuacgggcuguucaagaagaugagccucgaggagcaguccauucaccugaucgagcugcucaaccugcugacuaaccagaagaccaccuucgaggucaagccgcucggcaucacggccagccggagcaccgugggcuccaagaucagcaaccaggacgaguucaaggugaucaacgaauccaucaccgggcuguacagcaaugaggucacaaucguguga

SEQ ID NO: 7948 - RNA, 4233 nt, Artificial Sequence; identical to SEQ ID NO: 2148
  Cas9 variant

SEQ ID NO: 7949 - RNA, 4236 nt, Artificial Sequence
  Cas9 variant
auggucaaaaaggaguacuucaucggccuggacauggggaccucuuccgucggcugggccguggccgacaccaacuacaaccuccugcgcgcgaaggggaaggacauguggggcguccggcuguuccccgaggccagcacggccgccgaccgccggucccaccgcaccgcccggcgcaacaacaagcggaaggcggcccgcgagggguuccuucgggagaucuucgaggacgagaucaacaagaucgacccgggcuucuucgagcgccucaaggagagcaaguacuaccuggaggacaagcucaccgacaccccuuucguccuguucgccgacaagggcuacacggacaaggaguacuacgacgaguaccccacgguguuccaccugauaaaggagcucaucuccgaaaaggggcuggagccccacgacauccggcugguguaccucgccugccugaacaucuacaagcaucgcggccacuuccugaaugacacccucagcggugacggcaucgacaacaucaacucccugugcaacgauuucaccagcuaccuggcggauuacaaccagaacuccgaggacgacgggacugagaagauggaccucgauagcacgguccuggccggcguguucgaggaaacccugugcaacaagcaccucuccaacagcgccaagaagcgggaccugaucgacaagcugggcaucaccaacaagacgaaguaccucacggagaugauggcccugaucuccgggcuggccagcuccgugagcaacauguucgcgaaagacaccuacgacgaggagcagaagaaguucaagcucuccuuccgcagcuccaaccuggacgaggacauggucaaggugcaggccaugcugaccccggaggaguacgagaugaucugcaucaugaagaagauccacgacuggagcguggucagcgugaucauggguucacacaaguacaucagcgacgccaggguggagcucuacgagaagcacaagcaggaccuggccaagcugaaggccaucuacaaggaauaccuccccgacaaguacgacgcgauguuccgcgagaugacggacaacuccuacagcgccuacgucgggaagguuuccagcaacaagaagucccaaaccggcaaccacaaggugcggaugcagcgccggggcgccaagugcaagcaggaggacuucuacgaccgcaucaagaaggagaucaacagcgucccccaggaggagaagaucgacauucugcaggacauggagaccaacuccuuccugcccaagcaguugaccaacgagaacggggugaucccguaucagcugcaccuggccgagcucaagaagauccuggacaacgccagcacauaccugcccuuccucaacuccgcggacgagaccggcaucagcaacaaggacaagaucauccagcuguucgaguuccggauccccuacuacguugggccccuguucaaguccgagaagaacaagaccaacgccugggucgugcgcaaggagagcggcaagguguacccuuggaacuucaacgagaagaucgacgagaagcaguccgcggagauuuucaucgagcgcaugguccggcacugcaccuaccucaacaacgagagcgcccugcccaaaaauucccugaaguacgaacgcuuccgggugcucaacgagcugaacaaccugcgcaucaacggggagcggaucagccccgagcugaagcagcgcaucuacaacgagcuguucaagguaaagaagaagcggaucacgaaguccaugcucugcgaguaccuguacaagaauggcaucgccgacaaggacagcgaacuaagcggcuucgacgggaccuucgcgaacgcccugcuauccuacggcaaguuccgcgagcuguucaacguggacacccucaccgacaagcaggaggccgccgcggaggacaucaucaaguggagcacgguguacggggacuccaagaaguuucugcaggagaagaucgaggagaacuacggcccagagagcgagaacccgcugcuggacaacaagcagaucaagcgggucaugggguacaaguucacggacuggggcaaccugucccgcgaguuccucaaccuggagggcgccgacaaggacaaugacaccaccacgggggaggugaugccccugaucacccggaugugggaggagaacuacaaccucauggagcugaugagcaacaaguucuccuaccgcgacgcccuggccgagaagaccgaggagaucgagaagacccucacggacaucgaguacgaggaccuagaggaucuguacaucagcgcccccgucaagcggaugaccuggcagacccuccugauccugaaggaaaucuaccagauaauggguuacgcgcccaagaagaucuucgucgagauggcccgcgaggaggaggaaaaggugaacgggaagggcgcccggaaguccagccgcaagaagcggcucgaggaccuguaccgcaacugcaaggaugccuccaaggagcugagcacagggaucaagaacgccgacgaggcgauccuccggcgcaaaaagcuguaccuguacuacuugcaaaagggcaagugcauguacuccggcaaaacuaucgacuucaagagccuguucacgaacaacuacgacaucgaccacaucuacccgcaguccguggucaaggacgacagccuggagaacaacauggugcucguggagcgcaacuacaacaacaagaaguccgacaccuuucccaucuucagcgacuggcagaacaagaugaagcccuucuggaccaugcugaaggaacagggguucaucaacgaggagaaguacaagaggcugacccgcacggacgagcucaccgacgacgagcuggccaacuucgucaaccggcaguugguggagacccgccaggccaccaaggugaucgccgaacuccugaagaacagcuucgacgacaucgacuccaagaucgucuaugccaaggcgggcaacgugagcgaguuccggcacaaguucuccaugaaguacgacaaggagacggaaaaguccucggugauccaccccgagcuggucaagugccgcaucauaaacgacuuccaccacgccaacgacagcuacuugaacaucgugguggggaacaucuacgacgucaaguucacccagaacccguacaacuacaucaaggaguacaagaagcagaagaacaacuccgcccugagcgagcaggagaaggagaaguaccacauggacaagaucuucaacuucgacgugaagcggaacggggagguggccuggaucucccgcggagacaacaagacccuagagaccguccucaaggugaugcggaagaacacgcccaucgucacccgcaugaacuucgaggagcauggacagcuggcggaccugaccaucuacagcgccuccgacgcccucagcaagaagggcgucggguacaucaaggugaaggccucagacgcccggcuggacgugcugaaguacggcggguacaagaaguacaagggcgcguacuucuuccucgucgagcacaccgagaagaacaagcgcgugcggacgaucgagaacaugcccuuauaccugaagaacgagcucaacaccaaggagaagaucgagcuguggugcgccgacaaggagaacggccuggggcucguggaccccgacguccgccugggcaagaucaagcuguacagcaagauccggaucgacggguucgaccucuaccugaccggccgcaccgggaacaaccugcuaacguccaacgccgugcagcucaagaucggcagcaacaagccguccgacaacgacaagcuguucuggcgguacuacaucaauaagcucagcaaguacaccgagaacuccgaguucgugagcauccagaacaacauaaagcuguacgaccuguucgucgagaucaauaacgccggcguguacagcaagcgccagaaccccaucggggacaagcuccuggagggccgguccaaguucaucaaccugacccucagcaagcaggucgagacccugcuggggaucauccgcaucuacucccucgagaaccagggcgccgaccugagcaacaucgggggccaggagaaaaacggcacgaugaagccucacaagcggaucuccgacaagaaggaagugcugcucaucaaccagagcgugaccgggcuguacgaguccaagaucgaccugcucaagaucuga

SEQ ID NO: 7950 - RNA, 4236 nt, Artificial Sequence
  Cas9 variant
augaagaacauccugggccucgaccuggggacgaacagcauaggcugggcccugaucaagcagaacgccgaggaacgccagggguccauccucggcauggggacccgggugcugcccaugagccaggacguccugggcgauuucggcaaggggaacuccgucagccagacggcggcccgcaccggcuaucgggggauccgccggcuccgcgaaagauuccuguuacgccgggagcgccuccaccgggugcugaacauccugggcuuccucccguacuacuacgccgcccagaucgacuucgacaagcgcuucggaaaguucaaggccgagaccgagcccaagcugcccuacaacaacgagggcuucaucuucaagaacuccuucgaggagaugcugagcgacuucaagaucucucagcccgagcuccugagcggcaacaagaaggucccguacgacuggaccaucuacuaccugcggaagaaggcggugucccagaagaucgagaaggaggagcucgccuggauccugcugaacuucaaccagaagcgcggguacuaccagcuccggggcgaggacuucgacgaggagaaggacaagacguucgugacccugaacgucgacaaggugaucgacagcggggagaaggugaagggcaacauccuguucgacaucuacuucaccaacggcuggaaguacgagaagcagaccacgaagcccgaggacuggcucggucgcuccaaggaguucauaaucaccgagagccugcugaagaacggcgagguccgccgcaccuucaaggccguggacuccgagaaggacuggaucgccaucaaggcgaagaccgagcaggagaucgagacggcgcacaaaaccguggggagcuacaucuacgacgccauucuccagaaccccaaacagaagaucaagggcaagcugguccggaccaucgagcgcaaauucuacaaggaggagcugcggaaaaucuuagagaagcagaaggacuuccaccuggagcugcagaacgaggaccucuacuccgacugcgugcgagaacuguaccgcaacaacgauacccaccagcuaagucucgccaagaaguccuucauccaccuguuccuggaggacaucaucuucuaccagcggccccucaaaagccagaaguccagcgugagcaauugcacgcucgagugucgcaaguaccgggacaagaacggagccgagggcauccaguuccugaaggucaucccgaaguccaaccccuacuaccaggaguuccgcauuuggcaguggaugagcaaccucaagaucuaccggcgcgacgacgacgugaacaucaccuccgagugccugaagaccgcggaggacuacgaggaccuguucguguuccucaacauccggaaggaggucgaccagaaggccugccugcgccacuucaagcugagcgagaagacccaucgguggaacuacguggaggacaagaaguaccccugcaacgagacgggcaccaugaucuccgagcgccucaagaaggugggggacagccccgauaacaucuucacccgggaaauggagcagcagaucuggcacaucaucuacuccgucaacgauaagaccgaguacgagaaggcccucaagagcuucgcgaagaagaacgaacuggacaacgacuccuucuucgaggccuuccgcaaguucccgcccuucgacagcgaguacggcuccuuuagcgagaaggcgaucaagaagcugcucccccugaugcggaucgggaagcacuggaacugggaggccguggaugagaagaucaagaaccgcauccagaagaucaucaucggcgaguacgacgagaacaucaaggacaacauccgggaaaagacgcugucccuccagaaggaaagcgacuuccaggggcugccccuguggcucgcccaguacguggucuacggccgccacuccgaggccagcguggccggcaaguggaacuccgucgacgacaucgaggaguaccugaaggaguucaagcagcacagccugcggaacccgaucguggagcaggucaucauggagacggugcgcguggugaaggacaucuggaucaaguacgggaacggcgcggccgacuucuucgaugagauccacaucgagcucgggcgggagaugaagcuacccgccaaggagcgcaacaagaugacccagaagaucuccgagaacgagaacaccaaccugcgcaucaaggcccuccuggccgagaugaugaacgacagcgagguccagaaugugcggcccuacagucccaugcagcaggaaauccugaagaucuacgaggacggcgcgcuaaacuccgagaucagcguggacgacgacauccugaagaucuccaagacggcccagcccagccccuccgaccugaagaaguacaagcucuggcuggagcaaaaguaccgcagccccuacaccggggacaucaucccccugaacaagcuguucaccaccgaguacgagaucgagcacaucaucccgcaaucccgguauuucgacgacagcuucuccaacaaggucaucugcgagagccucgugaaccgccugaaggacaacuauaucggccucggcuucaucaagcaguuccacggguacaagaucuccgacaagacgaagguguucgaggucgaggaguacgaggacuucgugaagaagaacuacgccaacaaccggagcaagcgcuccaagcuguuacucgaggagauccccgaggagaugaucgagcggcagcugaacgacacccgcuacaucagcaaauacaucuccggcauccucagcaacaucguucguaagaaagagaacgacgagggggucaacuccaaagacaucauccccggcaacggcaagaucaccagccaguugaagcaggacugggggcugaaugacguguggaacgaccugauccucccccgcuucgagcggaugaacgagcugaccaagaguuccuacuucacgguguggaacgagaaguaccagaaguuucugccgaccguacccguggaguucagcaagggcuucuccaagaagcgcaucgaccaccggcaccacgcccucgacgcacuggugaucgccugcgccaccaaggaccacgucaaccugcucaacaacaagagcgcgaaguccgagaugaagcgcuacgaccugaagcggaagcugaugaaguucgagaagaagaccuaccagcacagccagaccggggagcgcaucgugaaggacgugcccgucgaguuccucaagccguggaacgacuucacgguggaggccaaggagaaccuggagaagaucaucguguccuucaagcagaaccugcggguuaucaacaaggcgaccaaccacuacgagaaguggaucgagaaggacaacgugaaggucaagggccucgucgagcagcaggggcugaacugggcgauccgcaagccccugcacaaggacaccgugucaggcaagguggaccuccccgggaucaagguccccaaggggaagauccugaccgccacgcggaaguccaucgacacgagcuucgaccugaagaccaucaacuccaucaccgacacgggcgugcagaaaauccucaagaacuaccuggaguacaaggggaacucuuccgaggaggccuucagcuccgaggggaucgaggacaugaacaacaacaucgagaaguucaacgaggggaagcugcaccagccgaucaccaaggugcgcaucuucgagcucggcagcaaguucccccugggccagaucgggaacaagaagcacaaguacgucgagaccgccaagggcaccaaccuguucuucgcgaucuacgaggacgacaaggggaagcggacguacgagaccaucccccucaacgaggugaucgaacgccagaagcaaggccuggcccccguaacccugaaguccaagaaugacuucuaccucugccccaacgaccuggucuauguggccgccgagggggaaagcgucaacaagaucgacuucaaguacgccucccaggaguucauccacaacaucuacaaggucgugagcuucagcggcucccagaucuucuucgugaagcagaacaucgcggucagcaucgugaauaaggccgaguucuccacccugaacaagauggagcgcgccguggacgggaagaugauaaaggacugcugcaucaagcucaagaucgaccggaucgggaacaucaccaagagcuga

SEQ ID NO: 7951 - RNA, 4239 nt, Artificial Sequence
  Cas9 variant
augaugaccaagaacauccugggccucgaccuggggaccaacagcaucggcugggcccugaucaagcagaacgccgaggagcgcaagggguccauacucggcaugggaacgcgggugcugcccaugagccaagacgcguuaggcgacuucggcaaggggaacuccgucagccagaccgccgcccgcaccggauaccgcggggugcggcggcuccgugagcgguuccugcugcgccgggagcgccuccaccgggugcugaacauccugggcuuccucccggacuacuacgccgcccagauugacuucgacaagcgcuucgggaaguucaaggcggagaccgaacccaagcugcccuacaacaacgagggcuucaucuucaagaacuccuucgaggagaugcugagcgacuucaagaucucccagccagagcuccugagcgagaacaagaagauccccuacgacuggacgaucuacuaccugcggaagaaggccgucucccaacgcaucgaaaaagaggagcucguguggauccugcugaacuucaaccagaagcggggcuacuaccagcuucgcggggaggacuucgacgaggagaaggacaagaccuucgucacccugaacgucgacaaggugaucgauucgggcgagaaggugaaggggaucguccuguucgacguguacuucaccaacggcuggaaguacgagaagcagaucacgaagccggaggacuggcucggccgguccaaggaguucaucaucaccgagagccugcugaagaacggggaggugaagcgcaccuucaaggccgucgacuccgagaaggacuggaucgccaucaaggccaagaccgagcaggagaucgagaucgcccacaagacggugggcagcuacaucuacgacgccauccuccagaaccccaagcagaagaucaaggggaaacugauccggaccaucgagcgcaaguucuacaaggaggagcugcggaagauccucgagaagcagaaggaguuccaccccgagcugcagaacgaggaccuauacuccgacugcguccgcgagcucuaccgcaacaacgacgcccaccaguuaagccuggccaagaaggacuucauccaccucuucgucgaggacaucaucuucuaccagcggccgcugaagucccagaaguccucugugagcaacugcacccuggagugccgcaaguacaaggacaagaacggugaggagcggauccaguuccucaaggugauccccaagagcaaccccuacuaccaggaguuccgcaucuggcaguggauguccaaccugaagaucuaccggcgcgacgacgacgucaacaucaccagcgaguaccugaagacaaccgaggacuaccaggaccucuucguguuucugaacacccggaaggagguggaccagaaggcgugccugaagcacuucaagcucaacgagaagacccaccgcuggaacuacgucgaggacaagcgguaccccugcaacgagacggggaccaugauccuggagagauucaagaaggugggcgauuccgccgacaacaucuucacccgggagauggagcagcagauguggcacauaaucuacagcgugaacgacaagaccgaguacgagaaggcccugaaguccuucgccaagaagaacgaccucgacaacgucagcuucuucgaggccuuccgcaaguucccgcccuucgacucagaguacgggagcuucuccgagaaggcgaucaaaaagcugcugccccugauccggacgggaaaguacuggaacugggaggccgucgacgagaagaccaagaagcgcauccagaagaugaucaccggcgagugggacgaggacaucaaggacaacauccgggagaagacccucagccugcagaaggaguccgacuuccaggggcugccccucuggcuggcccaguaugccgucuacggccgccacagcgaggccuccguggcggggaaguggaacagcgugaacgacauggaggaguaccugaaggaguucaagcagcacucccuccggaacccgaucguugagcagguuaucacggagaccauccgcguggugaaggacaucuggaucaaguacggcaacggcgccgccgacuucuuuaacgagauccauaucgagcuggggcgggagaugaaguuacccgccaaggagcgcagcaagaugacccagaaaaucuccgagaacgaaaacaccaaccuacgcaucaaggcccugcugguggagaugaugaacgacagcgaggugcacaacguccggcccuacucccccaugcagcaggagauccuuaagaucuacgaggacggcgcgcugaacagcgagaucagcguggacgacgacauccugaagauuuccaagacggcccagccuagccccuccgaccucaagaaguacaagcuguggcuggagcagaaguaccgcagccccuauaccggggacaucaucccccucaacaagcuguucaccacugaguacgagaucgagcacaucaucccgcagucccgguacuucgacgacagcuucucaaacaaggugaucugcgagagcuccgucaaccgccugaaggacaacuacaucggccucggguucauuaagcaguuucacggcuacaagaucagcgacaagacgaaaguguucgagguggaggaguacgaggacuucguuaagaagaacuacgccuccaacuggagcaaacgguccaagcugcuacucgaagagauucccgaggagaugaucgagcgccagcugaacgacacccgguacaucucgaaguacaucuccggcauccugagcaacaucgugcgcaagaaggagaacgacgacggggugaacagcaaggacaucauccccggaaaugggaagaucaccagccagcucaagcaggacuggggccugaacgacgucuggaacgaccuggugcucccccgguucgagcgcaugaacgagcugacaaagagcaacgacuucaccguguggaacgagaaguaccagaaguuccugccgacgguccccguggaguucucgaagggcuuuagcaagaagcggauagaccaccgccaccacgcccucgacgcgcuggugaucgccugcgccacccgggaccacgucaaccugcucaacaaccagucagcccgcagcgagaugaagcgguacgaccugaagcgcaagcugaugaaguucgagaagaaggccuaccagcacucccagaccggggagcggaucguuaaggacgugcccgucgaguuccucaagccuugggacaacuucaucguggaggcgaaggagaaccuggaccgcaucaucgugagcuucaagcagaaccugcgugucaucaacaaggccaccaaucacuacgagaaguggauagagaagaacaacgugaaggugaaggcccucgucgagcagcagggccugaacugggccauccgcaagccccugcacaaggacacgguguccgggaagguggaccuccccggcaccaagguccccaaggggaagauccugaccgccacccgcaagagcaucgacacguccuucgacaugaagaccaucaacuccaucaccgacaccggcauccagaagauccugaagaacuaccucgaguacaagggcuccuacgaggacgcguucagcccggagggcaucgaggacaugaacaagaacaucgagaaguucaacgacggcaagcagcaccagcccaucaucaaggugcggaucuucgagcugggauccaaguucccccugggccagaucgggaacaagaagcacaaguacguggagacggccaaagggaccaaucuauucuucgccaucuacgaggacgacaagggcaagcgcaccuacgagaccaucccccugaacgaggucauugagcggcagaagcaggggcuggccccggugacguucaagagcaagaacgacuucuaccucucccccaacgaccugguguaugucgccgcggagggcgagagcguggacaaccuggacuuccaguccgacagccaggaguauaucaacaacguauacaaggucguguccuucagcgggagccagaucuucuucgugaagcagaacgucgccguguccaucgugaacaaagcugaguucagcacccucaacaagauggagcgcgccaucgacggucggaugaucaaggaaugcugcgucaagcugaagaucgaccgcaucgggaacaugaccaaguccuga

SEQ ID NO: 7952 - RNA, 4245 nt, Artificial Sequence
  Cas9 variant
augaagaagauccucggccucgaccucgggaccaacagcaucggcugggcuuucguagaggaggccgaaaacgaguccgagaaguccuccaucaucaaacuggggguccgcgugaacccccucacuguggacgagcaacagaacuucgagaagggcaagagcaucacaaccaacgcggaccggacccugaagcgcuccaugcggcgcaaccugcagcgguacaagcagcgccgggagaaccucaucgacauccugaugaagaacggguucaccagcgacgacacgauacugucggaaaacggcaaccgcaccaccuucgaaaccuaccggcuccgcagcaaggccgucgccgagaagaucucccugcaagaguucgcccgggugcugcuuaugaucaacaagaaacgcggcuacaagagcucucggaaggccaaggggacggaggacggcgaacugaucgacgggauggagguggcgaagaagcuguacaacuacaaccucaccccgggccagcugugucugcagcuccugaacgaggggaagaaacaccucccagacuucuaucgcagcgaccugcaggcggaguuugaccggauauucgacauccagaugaccuucuacaccgaguaccugacgcuggagcuuaaagaggagcugcgcggcaagaagcgggacgccgucugggccaucugcgcgaagaucuucaaggagaagggcuucgagcugaucggaaccaaacgccagggcuccaccgcggagcagaagcacgagaacuacagcuggcgggccaaggggcucagcgagaagcuggagcuggagcagcucgugguggugcugcagcagaucaacauccagcugaacagcuccucuggcuaccucggcgccaucuccgaucgcaguaaggagcuguucuucaacaagcagaccguggggcaguaccagauggccguacuggacaagaaccccaacgcgggccuccggaacauggucuucuaccgccaggacuaccuggacgaguucaacgccauuugggagaagcaggccuuguuccaccccaucuuaaccgacacccugaaggacgagauccgcgacgugaucaucuucuaccagcggcgccucaagagccagaaggggcugaucuccuucugcgagcuggagucacggaagaucgagguggagauagccggccagaacaagacgaagauggucgggucccgcgugaucccgcggagcucaccgcuauuccaagaguucaagaucuggcagucacuaaacaacaucgagguguucggcaagggcaagaaguccaagaagcaaaaagagcagacccuguucgaucagaccgaggaccccuuggaguucgggggccgccgggagcucuacgaggaggagaaggagcuacuagccuuagaacucagcaucaagaaggagcugaagaaggcggacauccugaagcucuuguucgacaaccccaaggagcuggaccucaacuucaacgcuguccaggggaauuugacccaggccacccuuuucaacguguacaagaagauuauagagcucuccggccacgagaucgacguggagaaggauagcgccuccaagauccucaagagcauugaagagaucuucaaggcccugaacuacaacaccgagauccuucacuucgacuccgagaagucccaggaccagcaggcgauguacaugcuguggcaccuccuguacagcuucgagggggacaacagcaacacgggcaacgagaaccugaucaacaagaucuccaagcuguacggcuucgagaaggaguacgccaagauccucgccaacgucagcuuccaggacgacuacgggucccugagcgccaaggccaucagcaagaucuugccguaccucaaggagggccacaaauccgacaucgcgugcgaccuggccggguacaagcacagcgccuccagccugacccgcgaggagcucgagaacaagaccuacaaggacaggcuggagauccugcccaagaacaccuuaagaaaccccgugguagagaagauccugaaccagaugaucaacguaauaaaccugaucaucgacucgcgggagcucaagaaguccgccaaggagcgcgaggagcuuaccaagagcaucagcgagacgaccaaguuacaccagcaguacaaggacauccucgcgaaggcgcccuucaaccugaccaacacaucccggaacgacaucauccgcuacaagcuguacgaggagcucaaggacaauggcuacaagacacuguacucaaacaaguacaucuccccggccgcccuguucagcggggacuucgacaucgaacacaucaucccgcagucacgcuuauucgacgacuccuuuagcaacaagacacuggagcugcggucaaucaacaucgagaagggcaacaagaccgccuacgacuucaucaagggcaaguacggggagacuggcgaggacaacugucuugacaaguaccugaaccggaucgaaacccucuacaagaacgggauccucaagaaguccaaguacaacaagcugaagaugcaggacaaggacauccccgacggcuucaucgagcgcgacauccgagacacccaguauaucgccaaguacgccaagacccugcucggcgaccuggugaaguucgucgugagcaccagcggguccgugacggagcgccugcgcgaggacuggcagcucgucgaugugaugaaggagcugaacugggagaaauacaugcagcugggccucaccgaggaguucaccaacgaggaggggcacagaauccgaaagauaaaggacuggaccaagcggaacgaccaccgccaccacgccauggacgcccugacgguggccuuuaccaagcggcaguucauccaguacuugaacaacuugaacgcgcgcagaaucagcgacgagcagggcaucuccaacucggagaaggacgagcgcaacaacguguccaucaccaccaacgacaugaagcugaacacgcgggacguguuaggaaucgagaagaaggaacucuaccgcgacaaccgggguaagcugcgcuucaaggcgccgaugccgcugcucgaguuccgggaggaggccaagcgccaccuggagaacacgcugaucagcaucaaggcaaagaacaaggugaccaccaucaacaucaacacucucaagaaggccggcggggucuacaagaagacccagcugacgccccgggggcagcugcacaacgagaccauauacgggucccagaagcaauacaucgugaaggaggaaaccauuaacgcgaaguucgacguggagaagaucgccacagucaccaaucccguguacagagaggcgcuccugaagcggcuggagcagaacaacaacgaccccaagaaggccuuuaccggcagcaaugcgcucacgaagaagccgaugugguucgacgaacagcagaccgagaaggugcccgagaaggucaagaccguguccuucgagacuaucuacacgauccgcaaggaaaucagccccgaccugaagaucgagaaggugguggacgagaaggugcggcagauccugaacaaccgccucaacgaguacaacgggaacgccaaacaggccuucucaaaccuggacgagaaccccaucuggcugaauaaggagaagggcaucaccaucaagcgggugaccaucaccggcaucaacaacgcccaggcgcuccacgagaagcuggacaaggacgguaagccgauccuggacggcgaggggaagaagcagcccgucgacuucgugaacacgggcaacaaccaccacguggcggucuauugcgacgccgacgggaaccuccaagagaacgugaucagcuucuacgaggccgugacccgccgcaaccugggccugcccauaaucgacaaagacuacaagaaggacgacggcuggcaguuccucuucuccaugaagcagaacgaguacuucguauuccccaacgagaguaccggguuuaacccgaacgagguggaccugcugaaccccgacaacuacucccucaucagccccaaccuguuccgggugcagaaguucaccaucaaggacuauuucuuccgccaccaccuggagacgaacgucgaguccaacagcacccucaaggggaucaccuggcugcggugcgggcugaacaacaucgacaacaucaucaaggugcgcauuaaccacaucggccagaucauccacgugggggaauacuga

SEQ ID NO: 7953 - RNA, 4248 nt, Artificial Sequence; identical to SEQ ID NO: 2153
  Cas9 variant

SEQ ID NO: 7954 - RNA, 4248 nt, Artificial Sequence
  Cas9 variant
augaaccucaggaacgucgcaaaagaaggcauuaacuacaacauagggcuugacuuaggaaccggcagcguaggaugggcaguaacagaugagcaaggagagcuuuucucauucaaaggaaaaacuaccuggggaagcagaauauucccaacggcagaaaccgcggcagacacgcgccuaaagcggggucaacgccgccgcuacgcgagacgccgauggagacuggaccuauuacaaagccucuucgaagaggagauaaagaagguggacccugaguucuucaccagacuacgccaaagccaucugcuaaaagaagacaagacauacgcagcaauucuuaguaguaaaggggccaccagaccacuauucccagaaggcgaagcagaagucgaguacuacaaaaaguacccgaccaucuaccaccuacgaaaggcucugauggagagcaauaaccaggaagacauacggcucaucuaccuagcauuccacaacauaguaaaagccagaggcaauuuccuccaccaagacacacccggccuuacggcaagcaacgcaaauaugggagaugccguagagaaacucugcuccgcgcucgaagacuggugcagcagucaaaacauugagugcgccauccgaaagaaccagaaaagcauccaggaccugauggaagggaaaaccauagagcccagugaaagcaacgcgcuaaaagagaccuucgacgcaucacggucaagcagaaaagacaaggccagugugcucgcaggauggauagcaauacagcccggcgagcaguucgaaccuaagcaagcaaaggacgcaucaaaagaaauagccaacgcaguauucggguugucagcaaacaugaagaaggucuucguggaacucgaagaagaccagaaaauauaccuaaauaacgacgaacaaguggaagcauucuacaccgucugcccggacgaaggaguggcacucuucgaagccuugcaaagcauguauagcgccuacgugcuaauggggauccucaaaggagccgacggagggucgauauccagcugcaaaguggcggcuuacgagcaauacaaagaagaccuuaaacuccucaaaacccuaguacgggaguucgcgcccaaaaaguaugacgaguucuucagaggggacaucuuugacgccaaaaagggcuuuagaacgcgcaacuacgaccccgccaccgcgaaaggauacacaaaauacaacucgguacgcggcgcaagcuacgacgcguuuaaaaaggaaguugaaaaacuauucgagggaacagcagccgaagaagacguccgguacacagacaugaugcaacgcuucgacgaaggaacuuuucucagacgcuuaaagacgagcgauaauggcagcaucccauaccaguuacaccucgaagaaaugguagcgauaaucgaaaaccagaaaacguucuacccauucuuagaggaaaacaaagagaaauucgaaagccuagugacuuuccgcauaccauacuacgucggaccccuaacacagaagaacgcccgcccagacaaccacggaaacgcccgauuugcauggagccaacgaaaagagggccaagaaaacgcaagagucuaccccuggaacugggaagaggucaucgaccgcaaacaaucagccgccaaauucauggaacgacuaacagggaccugcacauacaucuuagaggaaccaguccugccaagauacuccuuacuguacgaggaauacugccuacuaaacgagcuaaacggcgcacgauggcgggauaugggcggagacuggcacagauuugacuacgagacacgcauggacauaauagaggaccuguucaaaaagaagaaaggcacgguaaaauacgcaacggucgcagauuggcuagugcgggaaaaacaccgcagcugcgccgaagucaaaggaggccaaggcgagacagguuuugaaaguaagcuaagcagcuacgucuucuucaaaggcguccuccacgucgacgaaaucgacgaggcagacauaccaaugauagaggaacuuauaugguggaacacacuauucgaagaccgguccauacuuaaagagagcauagaggacaaauacggggauagacucaacgacgaacaaaucaaagccaucugcaagaaaagauucacaggaugggggaggcuaagcaagaaacugcugugcggaaucaaagcacagacagacaacggacccugcucaaucauggauguacuaagggaaggcaacccaaauaacgaugcgcgcagcgccaccaugguauucauggagaucauccgagacgacaaauucggauucaccaaacuaauagaagaagaaaacaagaaacgaaucaguagcgucgaugacuucgacguaaacgaccuacccggcagccccgccguaagacgcaccguaaaccaagcaaagcguaucgucgacgaaauagucggaaucgcagguugugcaccccaaaacaucuucaucgaagucacgagagacgaagacggacggaacaaaggccgacgaacaaaacgucguuacgacgcgauacaagaagcugucaaaguccuuaagaaagagcagaaggaguacuucgacgcaaauguagcggaccuccugaaaaacacagcacccgcggcauuagacgaugaacgacucgcccuguacuucaugcaaaacggcaaaugcauguacugcggcaaagaccucgacaucaaccagcucgacaaauaucaagucgaccacauauugccccaaagcuauguaaaagacgacucguucgaaaacaaggcacugguucacagcgacgacaaccaacgcaaaagcaacagcaugcucuuagacgacagcauaauccgcaaaaugaagccauacugggaagccuuacgaucugcgggccuuaucggcgagaaaaaguucaagaaccuaacgcgcguacggguaagcgacaaggagcuuggcggguucaucgccagacagaugguggaaacgucgcagaguaugaaacucaccagccuacuccuagagcaagcauacccagaaacacaagugagacccgucaaggcaggguucucuagcgaccuacgacgucggcucaagcuagucaaaugucgggaaauuaacgacuaccaccacgcccacgacgcauaucuggcaugugaggucggacaauuuauagcccucagacacaacaaacuguacgaaaacccgauaggcuacagccacgcggugaaagacuucauagcaaagagagccaaauacgcaagcgagcacggaaaaccgauggacaccuacgguaugcccggaucguccucauuugucaucucauccuucaugacaaguggcuucgaugaagaaaccggggaaaucuucaaagacgcaugggacgccagcuuggccgcgguaaggauucaccaagcccugaaucgaaaagacuguuacaucucuaggaugcccgaggagaccucgggagcauuuugggacgccaccauuuauucccccaaacaaaccaagaaaaagcugucgcuccccuuaaagaaaggacucgacccacagaaguacggcucauacagccgggaacaguucgccuacuucuucgucuacgaagcaaagaaaaucaaaaagaaagaagaaacaaaagaauacgucuucgcuucgguaccaguucaaguagcagcccuaguggcagcagacccaaacgcgcuaauagaguucgccaaagcagaugccgaggaacggggccucaaauuugccaagaucguaagggaaaaaguuuauaaguaccaacugauagaaguuaacgacgaacgauuuuucgugaccggacuaagaacaguccgcaacggccugcaaauagcauuuucagaacaagaccgaaauauagucuccggaauaguagaaggcaacucaagcaacaacaaccuccuagacauauaugacaagaucacgaauagauaugcacuauacgccagccgauucggcaaacugcuaaaccuaagcggauaccgcgagaacuucauccaggcaucccuagaagaccaagaacgcguagugcucgcucucauaucacuauucaacgcacgaaccaacaugaucgaccucuccgcaauaggcucaagcaagaccgucggaaauauguccaugaccuuugccaaagaaauggcgauggcggacaacagguucgccuucauagaccaaagcguuaccgggaugcuagaacgaaaaacguacuuauga

SEQ ID NO: 7955 - RNA, 4251 nt, Artificial Sequence; identical to SEQ ID NO: 2155
  Cas9 variant

SEQ ID NO: 7956 - RNA, 4257 nt, Artificial Sequence
  Cas9 variant
augaaggugaagaacauccugggccucgacaucggggucaccagcaucggcuuugcccacgugaccgagaacgagaaggacaacaagucccacaucaagcaguuaggggugcgcaucaacccccugacggucgacgagcagaccaacuucgagaagggccggccggccagcgugaacgcggaccgcacccucaagagaggggccagaaagaugcugucccgguacaaggaccgccggaagaaccugaucgagauccucagcaagaccggcuucaucaacuccgagagcauccuggcggaggacggcaagaacacgacccacuccaccugggcccugcgcgccaaggcgagccgggagcgcaucgagaaggacgagcucgggcggguccugcuggccaucaauaagaagcgcggcuacaaguccagccggaaggccaagaacgaggacgaggggcaggccauugacggcauggcgaucgcgaagcgccuuuacgaggagaaccugaccccuggacagcuggucuaucagcuccugcgggagggcaagaaguacauccccgacuucuaccgauccgaccuacaggacgagcucgacaaaguguggaacuuccaaaagcaguuccaccaggagauccugacggacaccuucuacaaggacauucaaggcaaggggcagcgggcgaccagcgcuuccuucuacggcguguacggguucaacaccgccgagaacaagggcagccgcgaggagaagcggcugcaagcguacgccuggcgcuccgacgcccucacgaagcagcugacccgggaggaggucgccuuugugaucaccgagaucaacaacaaccugaacaacagcuccggcuaccucggggccaucagcgaccgcuccaaggagcuauucuucaacaagaagaccgugggccaguaccuguacgagcagcuccagcagaacccccacacucgccugaagaaccaggucuucuaccgccaggacuaccuggacgaguucgagaccaucuggaccauccaaagccgcuacuacccggagcucaccgacgaccugaagagagagauccgcgacguggugaucuucuaccagcggaagcucaagagccagaagggccucguaaguuucugcgagcuggagagcaaggagaucaugaucgagaagaacggcaaggcggccgugaagaaaaucggguccaagguggcccccaagagcagcccccuguuccaggaguucaagaucuggcagguccuccacaacguggacaucaagaacaagaaggacaagacgaagcgcccccuggacgacuccgagaaggaguaccuguucaacgagcucaacaucaaggguaaccugaaggccgccaaggugauucagcugcucacccugaauaagaacgagaccgaacucaacuacacccaacucgagggcaaucggacgcagaaggcgcuguacgaggcguaccugaagauccucgauaccgaggguuacgacgucaacaaccugcugggcaucaaguccaacaaggacgagguguuccuggacgauuuggacgugaacgccuuagaaaucaagaccaugaucaagcagauauucaacgcccugaacaucaacaccgggauccuagacuucgacgccgagcuagacggcaaggcguucgagcagcaggccagcuaccaccuguggcaccuucuguacuccuacgaggaggacgggagcaagucuggcaacgagcaccuguacaagcuccuggagaacaaguucggcuuuaagccagagcacgcccgcauccuggccgggaucacgcucagcgacgacuacgggaaccuguccgcgaaggccaugcggaagaucuacccccagaucaaggagaacaacuucagcaccgccugcgagcuggucggguaccgccacuccaagaacagccucaccaaggaggagaaccaggagcggccccugaagaacaagcuggagcuccuuaagaagaacucccugcgccagcccguggucgagaagauccugaaccagaugaucaaccuggugaacgagcugaucgacaagaacagcgagaaggaugagcagggcuccaucaucgaguacuuccgguucgacgagauccgcaucgagcucgcccgggagcugaagaagaacaccgacgagcgccgggaccuggacgccgcgauccgcgaggggaaccuccggaaugagaagaucuacaagcugcugcaggcucaguucggcaucaagaacccgacgcgcaacgacaucauccgcuaccggcucuacgaggagcugaagaacaacggauacaaggaccuguacaccaacagcuacaucccccaggagaagcuguucgggaaggagaucgacauagaccacaucaucccccagagcaagcuguucgacgacagcuucagcaacaagacccugaccuacaacacgaccaacaaggacaagggcaaccagaccggguucgacuauaucgaguccaaguacggcaucgacggcaucgaggccuacaccgcccgcaucgagaaccucuucgagagcgggaagaaaaacaaggaggagggcguguccaaggccaaguaccagaagcugcugaagaaggagagcgagaucggggacggcuucaucgagcgggaccuccgcgagucccaguacaucgcgaagaaggccaaggagcugcugcuccagaucacccggagcgucguggccacguccgggagcaucaccgcccgccugcgggaggacugggaccuggugaacgucaugaaggagcucaaccugcccaaguaccgcgcccugggccucaccgagauggaggagcggaaguacggccagaagguggaggugaucaaggacuggaccaagcgcgacgaccaccggcaccacgcgauggacgcccugacgaucgcauucaccaagcacaaccacauacaguaccugaaccaccucaacgcccgcaaggacgagcagcacaaggagcacaagaucaucaacgcgaucgagaacaaggagaccauccugauuaccgacaaguccgggaaccggaagcgcgucuucaaggccccgaugcccaacuuccggcagacugccaagcaguaccuggaggaggugcucaucagccacaaggccaagaacaaggucgucaccaagaacaaaaacaagauccugggcaaggagaagauccaggagacccugacgccccgcgggcagcuacacgaccagaccaucuacggcuuuaacugguggucccggauaacccugagcaagaaggugucccgcaacgagaucgagaagaucaucgacaacaacaccaaguucuuccugcaggaguucauccagcucaagggauccaucgccaaggcguucuccgacgccgagcugaacaagcugauguacaagggcaagauccucaaggagaucgagguggccauccccuguuacacccagcggaucgacaucagcaaggucuucacggacagccagaaguccaacagcgccaaggagaagaacaucaagaacauccuggaccugaaggugcgcaacauccuccagaaccggcuguccgaguucaagggcgacuucaagaaggccuucagcgaccuggacaagaacccgaucugguucaacaaggagaaggggaucagcaucaagcgcgugaucaucagcggagucaagaacguggagccccuccacuauaagaaggaccaccuggggaacgacauccuggacggcaaggagaaccgcaucccuguggacuucauaaguaccgggaacaaccaccacgucgcgaucuaccaggacgagaagggcaaccuccaggagaagguggugagccuguucgacgccgucaagcuggugaacgccgacgagcccgugauugacaagaccuacaaccaggggcucggguggcaguuccuguucaccaugaagcagaacgagauguucgucuucccgaacgauaacacgggcuucgaccccaaggagaucgaccuucucgaccccuccaacaagaagcugaucagccccaacuuauuccgggugcaauccaucagcaucgugcaguacgggaacaacaucguccgcgacuucaaguuccggaaccaccucgaguccgugcugaacgacgacaaggugcuacacggcaucaccuuccagcagaucaagagccucgggccgcugcugaauaucgucaagguccgcaucaaccaccucggcgacaucguguccgucggcgaguacuga

SEQ ID NO: 7957 - RNA, 4260 nt, Artificial Sequence
  Cas9 variant
auggccaagccccagaacuacacuaucggccuugacaucgggaccaacagcgugggcuggacagucacagacgaccaaaacaauauccuccgcaucaagucgaagaaggcaaucggggcgcggcuguuugaagagggcaagguggccgccgagcgacggagcuuccgcaccacacggcgcagguugucccgcagaaaguggcgcaucaagcuccuggaggaacuguucgacgaggagaucucaaagguggacccgaacuucuucgccaggucccacgagucuuggauuucacccaaggacaagcgcgagcgguacagcgccaucgucuuccccacgccggaggaggacaagaaguuccacaacgaguacccgaccaucuaccaccuucgcgacaggcucaugaaggacgaccagaagcacgacauccgcgagaucuacguggcgauccaccacaucaugaaguacagagggaacuuccugcacgacgaauccauugagaccuaucgcucuggcaugaguagucuuggcgggggcgacgagcggacgauccugaacacgaaaauccuggacgaccuuaacgacgccuucgccgacaaucucgcgacacaggguaucuccguuaacagcgcgagugccgaccagaucaaugaaaucgucaccagcggccaccugaacguggauagccaaaaagccaucgccaagcuccugcugcccaccacccucucguccgacgacaaaaagcaggacaagaaaaucaagaagcuggcgaccgacgcggccaaaaauguggccucagccuggcugggguacaaggccaauuuugcggccauccuuaacauccaggagguugacaaggacaagaaaaagaucuauagcuucgcccugcagggcgccgacgaggaggacaagguggagacucuggagagugugcucagucaggaccagauagagaucguagaccgcaucauccgcauccgccacgcaaucguucugggcgaaauaauccccguggguaugacccuguccgaggccaugaucgaaaaguacgaucagcacgccaaggaccuuaagaaccuaaagaccgucauccgcaaccugaaggacaggaagaacgccgugaagcuccaagccaucuacgacuuauaugugaacaaccgccacgccgauaccgcgaaagcuaugaagcucgccggcgucaagaaacggaccgagcuacuagagcccgaggaguucaacaaguccaucgagaagcuacucgacgacaguccggugagcgccgagaucaagaagcgcauagcggagaaggacuuccucccccugcagcgguccaacaguaacggggugauacccaaucaacuccaccagaucgagcucgaugagaucaucaagaagcaaucuaaauacuauccauuccugggugagaccaacgagcaugccagcgccgacgucgcccgcaaggccccgacgaaacuugaccagcugcugacguuccggguacccuacuacgugggcccccugaucacuaaggaggagcaggaggagcaagacgggcacuccuucgcguggaugauucgcaagaaccccaaggaccacgagaaaauaaccccguggaacuucgacgagaaggucgacaggauggccagcgcaacucaauucaucaagcgcaugaccaccaaggacaccuaccuucugggcgaggacgugcucccauccucaucccugaaguaucagcuguucaccguccugaacgagcucaauaaccugcggauaaaccacaagaagcugacccgcgaggagaaagaacaggugauagaagaccucuucaaaaaguacaagaccgugaaggccgacaaguuuaagaacuacuggcagaaggggcacgccggccucgaugugaagauccaggguauggcggaccccgaaaaauucaauagcaccauguccacuuauaucgaccugcaaaagaucuucggcgaccaacucgacgacgcacaacgucaaaacgauuucgagaagauuaucgaauacagcacgaucuucgaggaccgcaagauccugggcgagaagcugcgggcggacuucguguggcucuccgaggaccaaaucaagagacugugucggcugcgccugcagggguggggccggcuuagccuaaagcuccugacccgccugaccgacgccgacgggcaaaacgugcucgagcgcuuacuaaauucaaacgacaacuuuaugcagaucgugaaagacccugugaucaaggccaagauagagcaaaagaaccagaagcuccugcgagcagacugguccgagaacgccacggagagcauccuggacgaagccuacaccuccccgcagaacaagaaggcgauccgccaggugaugcgggucgugcacgacaucgugaaagcaugcgacggcaaccuccccgccaaauuugccaucgaguuugccaggagccaagaugacgacccuaagaggaccgucgcccgcgcggauagacugcagaagauauacgcccagaucuccgacgagguggugagccaaggggucaaggaccaacuguccggcaugaagucccucaaggaucgcuauuaucuauacuucaugcagggugggcgggacgccuacaccggcaagccucugaauauagaccgcuuguccgauuacgauaucgaccacaucaugccgcagagcuucauaaaggacgacucacucgacaaccgaguccuaguuacccgugccgugaacaaccaaaaauccgacaacgugcccgucuugcuguacggcaaccaccuggucgccgaccucgggaucacgauccgggagaugugggaccgguggcagaaguccgggaugaucucgaagcgaaagcuagcgaaucugcucaccgaccccgcaacucugagcgaguaccgcgccgagggcuucauuaaucggcagcugguugagaccucccaggugauuaagcucacggccaccauacugcaguccgaauuuccggacuccaagaucaucgagguuccggcaaaauacaacagcauccuacgcaagcaguucgaccucuacaaaucccgggagguuaaugacuaccaccacgcgaucgaugcuuaucugagcacaaucgugggcaauuaccuguaccaggucuaccccaaccuccgccgacucuucguuuacggggaguucaagaaguucucccacggagaagaggagaguucucaccaggccguacgccgcgucaagagcaugaacuuccuagacgaucuauugagagguaaacacggcgacgauaucuauugccgcgugaccggcgagguaaucuucucacggaaggauaucaucagcaagcugaaacaggccuacuccuucaagcagaugcucgucacgcaggagguguucaccaagaagagugcgcuguucgaccagaccgucuaccccagcccugcccgcgacagcaagacccgguccggacugaucccccgcaagcagggcauggacaccgagaucuacggggguuauagcgggaacaaagacgccuacuucguccucgcccagguugugaaguccaagggacacacccugcaaguugugggcgugcccauccgggcccugcgagcguuagccaacuguagcaacuauagugaacagcuguugaagaucgucaaagcucagguucucuucaacaagaagaccgguaaggccaagaagggcaucagcgacgugcggauacuacuggacaagauccccuaccgccaaccgguguuggacggguccgccuucuacaugcugggcuccuccaccuacaaguauaaccugaagcagaucucccugagccagcaguccaugaaauacauccuggauuacaucgacgaucccaacuucaauaagcacgagaugacaaagaucgaccaacagaacgagaaagagugcuuacucagcguguacgaugagauccuggacaagauggacaaguacuuaagccuauacgacaucaacgguuucaggaagaagcugcacgugggccgcgacaaguucaucaagcuggagguagagaagcaagcggaggccaucaaaaaugugcuccgcggcuuccaugcaaacagugauaugacgaaacugagcgacuuggggcucagcaccucccugggcuucaugcaggcuucugacgggaucaagcuguccgacaacgcgguuuucaucuaccagagcccuaccgggcuuuucgagcgccgagucaagguguccgauuuacugaaguga

SEQ ID NO: 7958 - RNA, 4260 nt, Artificial Sequence; identical to SEQ ID NO: 2158
  Cas9 variant

SEQ ID NO: 7959 - RNA, 4263 nt, Artificial Sequence
  Cas9 variant
auggccaagcccaaggacuauaccauaggcuuggacaucgggacgaacagcgugggcugggucguuacggacgaccagaacaacaucuuacgcaucaaggggaagaaggcuauaggcgcacggcuguucaccgaggguaagguggccgccgagcgccgguccuuccgcaccacccggcgucggcugagccgccgccgcuggcggauaaagaugcucgaggaacuguucgacgaggagaucgccaaggucgacccguccuucuucgcccgccugcacgagagcuggaucucccccaaggacaagcgaaagcgcuacagcgcgaucguguuccccucccccgaggaggacaagaaguuccaugagagcuacccgacgaucuaccaucuccgggacaaacugaugaaggacgaccagaagcacgacauccgagagaucuacaucgcgguacaccagaugaucaaagcccggggaaacuuucugcacgacgaguccguggagaccuaccgcagcggcaugucaagccucggcgggcgauccgagcgcaccauccugagcgugcagacgcuggaggagcucaacgaccuguucgccgagaacgaggggacggaggaaguggagcugaacgucgcguccgccgagcagaucaacgacaucuugaccggagggcaccugaacgccgacagccagaaagagaucuccaaccugcuccugcccucauccuucccgagcuucgacgacaaggcuaaggaaaagcaggucaagaagcugaucaacaacguugccaccaacauaagcaaggcauggcucggauacaaggccgacuucucaaccauccugaaccuggccaagguggacaaggaccagaagaagaucuucgccuucgcccuccagggcgaggacgaggaagacaaggugcaggagcuggagucccuguuggagcagucccaaacggauauaguggaccggcugaucgagauccgacacgcgauagucuuaagcgagauaguacccguugggaugacccucuccgaggccaugaucgacaaguacgaccagcacaaggaggaccugaucacccugaaggcugucauccgcaauaccaaggacaagaagaaggccgcuaaacuccaggcgaucuacgaccuguacgugaagaaccggcacgccgaucuggccaaggccaugaagcucacgggcaucaagaagcgcucggagcugcuggacccggaggagcucaagaaggggaucuccucacugcuggaugacucccccgaagccguggagaucaagcagcggcucgaggagaagaccuucuuaccccuacagcggagcaacaacaacggcguaauccccaaccagcuccaccagguggagcuggacgagaucaucaagaagcaguccaaguacuauccguuccuggcggagaagaaccccgacgagagcgaggaggcccagaagaaggcucccaccaagcucgacgccuuacugaccuuccgggugcccuacuacgucgggccgaugaucacaaaggaggaacaggaggcgcagaacgggcacuccuuugccuggauggugcgcagggauccccaggaccacgaagccaucacccccuggaacuucgagaaaaaggucgacaagauggccagcgcuacccaguuuaucaaacggaugaccacgaaagacaccuaccugcucggcgaggacgugcugcccgcguccucgcugaaguaccagcuguucacugugcucaacgaacugaacaaccuucgggucaacggcaagaagcugaccuccgacgagaaggagcaggucauugagggccuguucaagaagcagaaaacggucaaggccgacaaguucgugaaguacuggcaagccaaacacaucggggccgacaucaaggugaagggccucagcgacccgagcaaguucaauucaaccaugagcaccuacauugacuucaagaagaucuucggcgaccagcugaacgacgucaaccgccagaacgacuuugagaagaucaucgaguauuccaccaucuucgaggaccgaaagauccucgaggacaagcuccgcgccgacuucgcguggcuuagcgaggagcagaucaagcaguuaugucgguuacgccugcaaggguggggcaggcugagcgacaagcuccugacgcgccugacagacgccgaugggcagaacguccucgagagacuauggaacagcaacgacaauuucgugcagaucguguccgacccuaacaucaaggccaagaucgagcaggagaaccagaagcugcuccgcgacagccagucugacaacgccgucgaguccauccuggaugacgcauauaccagcccccagaacaagaaggcgauccgccaggugaugcgggugguccaugacaucgugaaggccugcgacggcaacgugccggccaaguucgccaucgaguucgcccggucucaggaggacgacccgaagcgaacaacggcccgugucaaccagaugcagaagauauacgaccagaucuccgacgagguggugagccagggggucaaggaacagcuguccggaaugaagucccucaaagaccgguacuaccuguacuucaugcagggcggucgcgacgcauacaccggcgcaaaauugaacaucgaccggcuguccgacuacgacguggaccacaucaugccccagucauucgugaaagacgauucccuggacaaccgcguccugguggcccgggccgugaacaaucagaagucggacaagguccccgcccuccuguucgggaacaaggugguggccgaccugggcaucaccguccgcgagaugugggauaaguggcagaaacucgggaugaucagcaaacggaagcuguccaacuuacucaccgaucccgacgcccugaccgaguacagagcccagggcuucauccggcgccagcugguggagacgagccaggugaucaagcucacagcgaccauccugcaguccgaguuuccggauagcaagaucaucgagguccccgcaaaguacaacucgaucgugcggaagcaguucgaucuguacaagagccgcgaggugaacgacuuccaccacgcgaucgacgccuaccucuccaccaucguuggcaacuaccuguaccagguguaccccaaucugcggcgcauguucguguacggggaguucaagaaguucagcuccaaugccgaagagagcgcgcaugacgucgcccggcgcgugaagaguaugaacuuccucgacgaccuucuccgggguacgcacggggacaacaucuacugcaggagcacgggcgagaucguauucaaccguaacgacaucauaucuaagcucaagcaggccuacaguuucaagcagaugcuggucacccaggagguguucacccgcaaguccgcccuguucgaccagacuguguacccgagccccgagcgcgacuccaagaaacggagcggccucaucccccgcaagaaagguauggacccggagaucuacggcggguacgcgcacaaccaggacuccuacuucguccuggccaagaucgagaaggugaagggcuacacccugcagaucgugggggucccgauccggucgcucgagauaaucaacaaggccgaggacuucagcaccgccuugcuggacaucauuaaguccaaagugauguacaacgagaagaccggccagccaaagcgcggcaucaagaacguggagauccucgugaauaagcuacccuaccgucagcccauccuggaaaaggacguaaguuacaugcucggguccagcgccuacaaguauaauaugaagcagaucacgcugucccgccagagcaugaaguacauccuagauuacaucgacgacccaaacuucaccaaacacgagaugaccaugaucgacgagcagaacgaacgggagugccuccuuagcgucuacgacgagauccuggagaagguggacaaguaccucccccuauucgacggcaacaaguuccgcgagaagcugcacagcgcgcguaaggaguucgucucccucagcgucgaugacgaggccuccgccaucgagaaaauucugcgcggguuacacgccaacucagagaugcccucccuugagaaccugaaaaucaagcccgcccugggcuucuuccagaugaagaauggaaucaccuuaagcaacgacgcagugcugcuguaccaguccccgacgggccucuucgaacggcgagugaaagucucugaccugcugaaguga

SEQ ID NO: 7960 - RNA, 4263 nt, Artificial Sequence
  Cas9 variant
auggccaagccuaaggacuacaccaucggccuugacaucgggaccaacagcgugggcugggucgugacggacgaccagaacaauaucuugcgcauuaaggggaagaaggccauuggcgcgcggcuguucaccgaggggaagguggccgccaagagacguuccuuccgcaccacccggcgccggcugagccgccggcgcuggcggauuaagcuccuggaagaacuguuugacgaggagaucgccaaggucgacccguccuucuucgcaaggcuccacgagagcuggauuuccccuaaggauaaacggaagcgcuacagcgcaaucguguuccccucccccgaggaggacaaaaaguuccacgagucguacccgacaauauaccaccuccgggacaagcugaugaaggacgaccagaaacacgacauccgcgagaucuacaucgccgugcaccagaugaucaaggcccggggcaauuuccuccacgacgaguccgucgaaaccuaccgcagcggaauguccagccucggcgggcgguccgagagaaccauccuaagcgugcaaacccuagaggagcugaacgaccuguucgccgagaacgaagggacggaggagguggagcuaaacgucgcguccgccgagcagaucaacgacaucuugacagggggacaccugaacgcugauagccagaaagaaaucuccaaccuccuguugcccagcuccuuccccagcuucgacgacaaagccaaggagaagcaggucaagaagcugaucaacaacguggccaccaacaucagcaaggcguggcugggauauaaggccgacuucuccaccaucuugaaccuugccaagguggacaaggaccagaagaagaucuucgcuuuugcccugcagggcgaggacgaggaggauaaggugcaggagcuggaaagccuccuggagcagucccagacagacaucguggaccggcugauugagauccgccacgcgaucgugcuuagcgagaucgucccuguggggaugacccuguccgaggcuaugaucgacaaguacgaccagcauaaggaggaccugaucacccucaaggccgucauccgcaacaccaaggauaaaaagaaagcagccaagcugcaggcgaucuacgaccuguacguaaagaaccgccacgccgaccucgcuaaggccaugaagcugaccggcaucaaaaagcgcagcgagcuguuggacccggaggagcugaagaaggggaucuccagccugcuugacgacucccccgaggccguggagaucaagcagcggaucgaggagaagaccuuccugccccuacagcgcagcaauaacaacggcgucauccccaaccagcuccaucagguggagcuggacgagaucauuaagaagcaguccaaguacuacccguucuuggcggagaagaaccccgacgagagcgaggaagcccagaagaaagcccccaccaaguuggacgcacugcucaccuuccggguucccuacuacguuggcccgaugaucacgaaggaggagcaggaggcgcagaacggacacuccuucgccuggauggugcgccgggacccacaggaccacgaggccaucacccccuggaacuucgaaaagaaggucgacaagauggcgagcgccacccaguucaucaagcgcaugaccacuaaagacaccuaucugcucggcgaggacgugcugcccgcguccagccugaaguaccagcuguucaccguccugaacgagcugaacaaccuccgugucaacgggaagaaacugacguccgacgagaaagagcaggucauagagggccuguucaagaaacagaagacggugaaggccgacaaguucgugaaguacuggcaggccaagcacaucggggccgacaucaaggugaagggccuguccgacccguccaaguucaacucuaccaugaguaccuauauugacuucaagaagaucuucggagaccagcugaacgacgugaaccgccagaacgacuucgagaagaucauugaguacuccacuaucuucgaggaucguaagauccuggaggacaagcuccgcguagacuuugccuggcugagcgaggagcagauaaagcagcugugccgacuccgccugcagggguggggccggcuguccgauaagcuacugacgcgccugaccgacgcggauggucagaacguacucgaacggcuguggaauagcaacgauaacuucgugcagaucgucucugauccaaacaucaaggcuaagaucgagcaggagaaccagaagcugcugcgcgacagccaauccgacaacgccguugaaagcauccuggacgaugccuacaccagcccccagaacaagaaggccauccgccaggugaugcgggucgugcaugacaucgugaaggcgugcgacggaaacguccccgccaaauucgccauugaguucgccaggagccaggaggaugacccgaagcggaccacggcgagagugaaccagaugcagaaaaucuacgaccagaucuccgacgagguagucagccagggggugaaggagcagcuguccggcaugaagucacucaaggaccgguacuaccuguacuucaugcaagggggaagggaugccuacacgggcgccaagcugaacaucgaucggcucuccgacuacgacguggaccacaucaugccccagagcuucguuaaggacgacagucuagauaaccgcgugcucguggcacgggcgguaaacaaccagaaguccgacaaagugcccgcgcuccuguuugggaacaaggucgucgccgacuuaggcaucaccgugcgcgagaugugggacaaguggcagaagcucgggaugaucagcaagcggaagcuaagcaaccugcucaccgaccccgacgcccugacagaguaccgcgcccagggauucauccgucgccagcugguggagacgagccaggucaucaagcucaccgccaccauccuacaguccgaguucccggacucgaagaucaucgagguacccgcuaaguauaacuccaucgugcguaagcaguucgaccuguacaagucuagggaggucaacgacuuccaccacgccaucgacgcauaccucaguaccaucgugggcaauuaccuguaccagguguaccccaaucugcggcgcauguucgucuacggggaguucaagaaauucagcuccaacgccgaagaaagcgcccacgacguggcgcgccgugugaaguccaugaacuuccuggacgaccugcuaagaggcacgcauggggacaacaucuacugcagaagcaccggcgaaaucgucuucaaccggaacgacaucauuuccaaacucaagcaggccuacagcuucaagcagaugcuggugacccaggagguguuuaccaagaaguccgcccuguucaaucaaacggucuacccgagccccaagcgcgacggcucaaagcgcagcgggcucauuccccggaagcgcggcauggaucccgaaauauacgggggcuacgcccacaaccaggacucccacuucgugcuggcgaagaucgagaaggugaagggguauacccugcagaucgucggcgugccgauccggagccucgagaucaucaacaaggccgaggacuucagcaccgcccugcuggacauuaucaaguccaagguaauguacaacgagaagaccggccagcccaagcgcggcaucaagaacguagagauauuaguaaacaagcugcccuaucgucagcccauccuggagaaggaugucagcuacaugcuuggcuccagcgccuauaaguacaacaucaaacagaucacacuaucccgccaaagcaugaaguacauccuggacuauaucgacgacccgaacuucaccaagcacgagaugaccaugaucgacgagcagaacgagcgggagugccuccuguccguguacgacgagauccuggagaagguggacaaguaccucccccuguucgacgggaacaaguuccgcgaaaagcugcacagcgcccggaaagaguucgucuccuuaagcguggacgacgaggcgucggccaucgagaagauccugcggggcuugcacgccaauagcgagaugcccucccucgagaaccugaagaucaagcccgcacucggguucuuccagaugaagaacgggaucacccucagcaacgacgccguccugcuguaccaguccccgacgggccucuucgagcggcgcgucaaggugagcgaucugcugaaguga

SEQ ID NO: 7961 - RNA, 4263 nt, Artificial Sequence; identical to SEQ ID NO: 2161
  Cas9 variant

SEQ ID NO: 7962 - RNA, 4263 nt, Artificial Sequence; identical to SEQ ID NO: 2162
  Cas9 variant

SEQ ID NO: 7963 - RNA, 4263 nt, Artificial Sequence; identical to SEQ ID NO: 2163
  Cas9 variant

SEQ ID NO: 7964 - RNA, 4263 nt, Artificial Sequence; identical to SEQ ID NO: 2164
  Cas9 variant

SEQ ID NO: 7965 - RNA, 4263 nt, Artificial Sequence
  Cas9 variant
augagucgcaagaacuacguggaugacuacgccauuuccuuggacaucggcaaugccuccgucgggugguccgcguuuacacccaacuaccgguugguacgcgcgaagggacacgagcucaucggggugcggcuguucgacccggccgauacugcagagucucgcagaauggcucgcacgacgcggcgcagauauucccgccggcgauggcggcuccgccugcuugacgcccucuuugaccaagcccugagcgaaaucgauccaaguuuccuagcacggcgcaaguacagcugggugcaccccgacgacgagaacaacgccgacuguugguacggcuccgugcuguucgacagcaacgagcaggacaagcgguucuacgagaaauaucccaccauauaucaccucaggaaggcgcugauggaagacgacucgcagcacgacauucgugaaaucuaccucgcgauacaccacauggucaaguaccgagguaauuuccuggucgaaggcacccuagagagcaguaacgccuucaaggaagacgagcuccugaagcugcucggccggauaacgcgguacgagaugucugagggggaacagaacuccgacaucgaacaggacgacgaaaauaaacugguagccccggcgaacggccagcuggcagacgcucucugcgccacuagagggagccgcuccaugcgcguggacaacgcgcuagaggcccuaagcgcagugaacgaccucucccgagagcagagagccaucgugaaggccauauucgccgggcuggaggggaacaagcuggaccuggccaaaaucuucgugagcaaggaguuuagcagugagaacaagaagauccugggaaucuacuucaacaaaagugacuacgaggagaagugcguccagaucguagacucaggccugcucgacgacgaggagcgggaguuucucgaccgcaugcaggggcaguacaacgcgauugcccucaagcagcuccuggggaggagcacuucugugagcgauuccaagugcgccagcuacgacgcccaccgcgccaacuggaaucugauuaaacuccaauuacgcaccaaggagaacgagaaggacauaaaugagaacuacgggauccuggucggguggaagaucgauagcggccagcguaaaucagugcgcggggaguccgcguacgagaacaugcggaagaaggccaacguguucuuuaagaagaugauagagacgagcgaucucucggagacggacaagaauaggcugauccacgacauagaggaggauaaacuguuucccauccaacgcgacagcgacaauggagucauuccccaccagcuccaucagaaugagcugaagcagaucaucaagaaacaggggaaauacuaccccuuccuccucgacgcguucgaaaaagacggcaagcagaucaacaaaaucgagggacugcugacuuuccgggugccguacuucguuggaccccucguagugcccgaggaccuucagaaaagugacaacucagagaaccacuggauggugcguaagaaaaagggggagaucacgccauggaacuucgaugagauggucgacaaggacgcuuccgggcgaaaguuuaucgagcgucuggugggcacggacucuuaccugcucggcgagccgacacuaccaaagaacuccuuacucuaccaagaguacgagguucugaaugaauugaacaacgugcgacuaagcgugcgcaccggcaaccacuggaacgacaagcgccggaugcgcuuggggagggaggagaaaacccugcucugccagcggcuguucaugaaaggccagaccgugaccaagcggaccgcggaaaaccuucucaggaaggaguacggccgaaccuacgagcugagcggguuguccgacgagagcaaguucacguccagucucucgaccuauggcaaaaugugucgcauuuuuggagagaaguacgucaacgagcaccgggaccugauggagaagaucguggagcugcagaccgucuucgaggacaaggagaccuuacugcaccaacugcgucagcuagaggggaucagcgaggccgacugcgcccuucuggugaacacacacuacacgggguggggacggcucucucgcaaguuacugaccacaaaggccggcgaguguaagauaagcgaugauuucgcgccccggaagcauuccaucaucgaaauuaugcgcgcggaggaccgaaaccucauggagaucaucacggacaaacaacuagguuucagcgacuggauugaacaggaaaaccugggggccgagaacgguagcagccucauggagguggucgacgaccugcgcgugucccccaaggugaagagaggcaucauccagagcauccgccugaucgaugauaucuccaaggcggucggcaaacggccgagccgcaucuuucucgagcuggcagaugacauccagcccucggggcggaccaucagccgcaaaagccgccuacaggaccucuaccgaaacgccaaccuuggcaaggaguuuaaggguauagcggacgagcugaacgccugcuccgauaaggaccuccaagaugaccgccuguuccuguacuauacccagcucggcaaggacauguacaccggggaggagcucgaccuggaccggcuuuccagugccuacgacaucgaucacaucaucccucaggcggugacgcagaacgacagcaucgacaaccgcguguuagucgcccgggcggaaaaugcccgcaagaccgacucguucaccuacaugccccaaaucgcggaccgcaugcggaauuucuggcagauccucuuggacaacggccugaucagccggguaaaguucgagcgccucacccggcagaacgaguucuccgagcgcgagaaagagcgguucgugcaacgcagucucgucgagacgcggcaaaucaugaagaacguggccacccugaugcgccagcguuauggcaauuccgcggcgguaaucgggcugaacgccgagcucacuaaggagaugcaccgcuaccugggguucagccacaagaaccgggacauaaacgacuaccaccacgcucaagacgcacugugcgucgggaucgcuggccaguucgccgccaaccgaggguucuucgccgacggcgaggucuccgacggcgcgcaaaacagcuacaaccaguaccuccgcgacuaucuacggggguacagggagaagcuguccgccgaagaccgcaagcaaggccgcgccuuuggcuucauaguagggagcaugcggucccaggacgaacaaaagagggucaacccgcggacuggcgaagugguguggagcgaggaagacaaggacuaccuccggaagguuaugaauuauagaaagauguuagugacccagaaggucggcgacgacuucggcgcccuguaugaugaaacgcgcuacgccgcaaccgaccccaagggcaucaagggaauacccuucgacggcgcuaaacaggacacaucccucuacggcggcuuuagcuccgcaaagccagcauacgccguccugaucgaguccaagggcaagaccaggcuggugaacgugaccaugcaggaguacagccuccucggcgaccgcccauccgacgacgaacugcgcaagguccuggcuaagaagaaguccgaguacgccaaggcuaauauccuccugcgccacgugcccaaaaugcagcucaucagguacgggggcggacugauggugaucaaaagugcuggcgagcugaacaacgcccagcaacucuggcugcccuacgaggaguacuguuauuucgaugaucugagccaggguaaggggucccucgaaaaggacgaccuaaagaagcuguuagacaguauccuuggcuccguacagugccuguaucccuggcaccgcuucaccgaggaggaguuagcggauuuacauguggccuucgacaagcugccugaggacgagaagaaaaaugucaucaccgggaucguuuccgcucuccacgccgacgcaaaaaccgcgaaccuuuccaucguaggcaugacggggagcuggcggaggaugaacaacaaguccggcuacaccuucagcgacgaagacgaguuuaucuuccaaucacccucgggcuuauucgagaaaagagugacaguuggggaguugaagcgcaaggcuaagaaggagguaaacuccaaguaccgcacgaaugagaagaggcugcccacguuaucaggcgccagucagccauga

SEQ ID NO: 7966 - RNA, 4263 nt, Artificial Sequence
  Cas9 variant
auggccaagcccaaggacuacaccaucggccuggacaucgggacgaauagcgucggcugggucgugacggacgaccagaacaacaucuuacgcaucaagggcaagaaagccaucggcgcgcgacuuuucgccgaggggaagguggccgccgagcgccgguccuuccgcaccacccgacgacggaucagcaggcggcguuggcggauuaaacuucucgaggagcuguucgacgaggaaaucgccaaggucgacccguccuucuucgcgcgccugcacgagagcuggaucucccccaaggacaagcggaagcgcuacuccgccaucguguuccccucccccgaggaagacaagaaguuccacgaaagcuacccgaccaucuaccacuugcgggacaagcugaugaaggaugaccagaagcacgacauccgcgaaaucuacaucgccgugcaccagaugaucaaaguucggggcaacuuccugcacgacgagaguguggagacguaccgcagcggcauguccagccuagggggccgguccgagcgcaccaucuuaagcgugcagaccuuagaggagcucaaugaccuguuugccgagaacgaggggaccgaggaggucgagcugaacguggcguccgccgagcagaucaacgacauccucacgggcgaccaccugaacgccgacagccagaaggagaucucuaaucugcuccugcccaguuccuuucccagcuucgacgacaaggccaaggagaagcaggucaagaagcugaucaacaauguggccacuaauaucaguaaagcguggcucgguuacaaggccgacuucagcaccaucuugaaccuggccaaaguggacaaagaccagaagaagaucuucgcauucgcccuucagggaggugacgaggaggacaaggugcaggagcuggagagccuguuagagcagucacagaccgacaucgucgaccggcugaucgagauccgccacgcgauugugcugagcgaaaucguucccguugggaugacucucuccgaggccaugaucgacaaguaugaccagcacaaagaagaucugaucacccugaaggccguuauucguaacaccaaagacaagaagaaggccgccaagcuccaggcgaucuaugaccuguacguuaacaaucggcacgccgaccuggccaaggccaugaaacucaccggcaucaagaagcgcagcgagcugcuggacccggaggagcucaagaaggccaucuccagccugcuggacgacucccccgaggcgggagagaucaagcagcggcucgagggaaagacuuuccugccucugcagcgcagcaacaacaacggcgucauccccaaccaacuccaccagguggagcuggacgagaucaucaagaaacaguccaaguacuacccauuccuggccgagaagaaccccgacgagagcgaggaggcccaaaagaaggcccccacaaagcucgacgcgcugcucaccuucagggugcccuacuacgucgggccgaugaucaccaaagaggagcaggaggcacaagacggccacuccuucgccuggaugguccgccgggacccccaagaccacgaggccaucacgcccuggaacuucgagaaaaaggucgacaagauggcgagugcuacccaguuuauaaagcgcaugaccacuaaggacacguaccugcucggggaggacgugcugcccgccaguagccugaaguaccaacuguucaccgugcucaacgagcugaacaaccuccgaguuaacggcaagaaacugaccuccgacgagaaagagcaggucaucgagggguuguucaagaagcagaagaccgugaaggcagacaaguucgugaaauacuggcaggccauccacauaggcgccgacaucaaagugaagggccucagcgacccgaguaaguucaacagcacgaugagcaccuacaucgacuucaagaagaucuucggggaccagcugaacgacgcgaaccgacagaacgacuucgagaaaaucaucgaguacuccaccaucuucgaggaccggaagauccuggaggacaagcuccgcgccgacuucgccuggcugagcgaagaacagauaaagcagcugugccggcuccgccugcagggcuggggacggcucuccgacaaguuacugacucgucugacggacgccgacggccagaacguucucgagcggcuguggaacagcaacgacaacuucguacagauuguauccgaccccaacauaaaggccaagaucgagcaggagaaccagaaacugcuccgcgacgggcagagcgacgacgcggucgaguccauccuggacgacgcuuauaccagcccccagaacaagaaggccauccggcagguaaugcgcgucgugcacgacaucgucaaggcuugcgauggcaacgugcccgcgaaguucgccaucgaguucgcgcgcucccaggaggacgacccaaagcggaccaccgcccgcgugaaccaaaugcagaagaucuacgaccagaucagcgacgaggucgugucccagggcgugaaggagcagcugagcgggaugaagucccucaaggaucgguacuaccuguacuucaugcagggagggcgcgaugcauacacgggcgcgaagcugaacaucgaccggcucucagauuacgacaucgaccacauaaugccccaguccuucgucaaggacgacagccucgacaaccgcguucugguggcccgggccguaaacaaucagaaguccgacaagguucccgcguuccucuucgggaacaaagucgucgccgaccugggcaucaccgugcgagagaugugggacaaguggcagaagcugggaaugaucagcaagcgcaaacugaguaacuuacugaccgaccccgacgcgcucaccgaguaccgcgcgcagggguucaucaggcgccagcugguggagaccucccaggucauaaagcugacggccacuauacuccaaagcgaguucccggacucuaagaucaucgagguccccgcaaaguacaacuccaucgugcggaagcaguucgaucuguacaagucacgcgaagucaacgacuuucaccaugccaucgaugcguaccugucgaccaucguggguaacuaccucuaccagguguacccgaaccugcggcgcauguucgucuacggggaguucaagaaauucaguucaaacgcagaggaguccgcccaugacauggcccgccgcgucaagagcaugaacuuucuggacgaccuccugcggggcacccacggcgacaauaucuacugccgcuccacgggggagaucguguucaaccggaacgacaucaucagcaagcugaagcaggcguacuccuuuaagcagaugcucgugacucaggagguguucacccgcaagagcgcgcuguucgaccagaccguguacccgucacccgagcgugauagcaaaaagcggucuggccugauuccccgcaagaaggggauggacacggaaaucuacggcggguacagcggcaacaaggacgccuacuucguguuggcugaggccgugaaggaaaagggccacacccuacaaaucgugggcguccccauccgggcucuuaacacccucaagaacuccgccaacuacagcgagaagcugcuggagauuaucaagccccaggugauguucaacaagaagaacggcaagccgaagaagggggugaacgacguacgcauccucauggacaacaucccguaccggcagcccgugcucgagggcggugcccuguacaugcuaggcagcuccaccuacaaguacagccugaagcagaucacgcugucccaggagagcaugaaguacauucuagacuacauagacgaccccuccuuuaacaagcacaucaugguuaacaucgaccaccaggaugaaaagaagugccugcucagcgucuaugacgagauccucgacaagauggacaaguaccuaccucuguucgauaucaacggcuuccgcaagaagcuccacgacgggcgggagaaguucgugaagcugcccguagagaagcaggcugagguggugaaggacauccugcgcggucuccacgcgaacuccgagaugacaaagcccagcgaccuggggcugaccaccgcgcucggcuucaugcaggccccggacgggaucaagaucucggacgacgccgucuucaucuaccagagccccacgggccuguucgagcggcgcguuaagguuuccgaccugcucaaguga

SEQ ID NO: 7967 - RNA, 4266 nt, Artificial Sequence; identical to SEQ ID NO: 2167
  Cas9 variant

SEQ ID NO: 7968 - RNA, 4266 nt, Artificial Sequence; identical to SEQ ID NO: 2168
  Cas9 variant

SEQ ID NO: 7969 - RNA, 4266 nt, Artificial Sequence
  Cas9 variant
augaaggacauccugggccucgaccuggggaccaacagcauuggcugggccguggucaaggaggcccagaacgacaacgagcaguccgagaucguggacguagggguccgugugaacccccugaccacggacgagaaaaccaacuucgagaagggcaagccgaucagcaccaacgcggaccggaccuuaaagcgcucugcccggcgcaaccugcagcgguacaagcugcgccggaaggagcuaauagagcugcugaaggagcaccagcucaucucuacggacaccauccugaccgagaacgggaagggcaccacuuuccagacccuggagcuccgcgccaaguccgccaaagagaagaucagccuggaggagcuggcccggguguuccucaccaucaauaagaagcgcggcuacaaguccagccggaaggcgaagaacgaggacgaggggcagcuuauagacggcauggagaucgcaaagcgccuguacgaggagaaccucaccacagggcagcugucccugcagcuccuuaaggagggcaagaagucccugcccgacuacuaccgguccgaccuccaguucgagcuggacaaggucuggaacuuccagaaacaguuccacagccacauccugaccgacgaguucuacgcccagcucaaggggaagggccagcgcgccaccuccgcgcuguuccuggccaaguaccagaucuacaccgccgaaaacaagggcagccgggaggacaagaaacuucaggccuaccaguggcgcgucgacgcccuguccaaggagcugacgcgggagcagcucgcguucgugaucaccgagaucaacaacaaccugaacaacagcuccggguaccugggcgccaucagcgaccgcuccaaggagcucuacuucaacaacgagaccgucggggaguacuuauggaagcagaucgccgccaacccgcauacaagccugaagaaccagguguucuaccggcaggacuaccucgacgaguucgagcagaucuggaaaacgcagagcgccuucuaccccgagauucugaccgagucccugaagaaggagcuccgcgacguggucaucuucuaccagcggaagcucaagagccagaagucccugguguccuucugcgaguucgagaacaaggaaaucgagaucaagaaggaggacggcaccuccaccaagaaggugaucggccucaaggucgcgcccaagagcagcccccuguuccaggaguucaagauuuggcagaaccugaacaacgugcucauccgcaagaaggggagcaagacgaagaaggccgcuaagaaccagcaggccgugcuguucgaagaggagaagacuaucuccgagcuggaccuggaggccaagcaggcccuguucaacgagcugaaccugaaaggcaaccucaaggccgacuacugccuggagauccugggguacucgccaaaggagugggagaugaacuacuccguucuggagggcaaucgcaccaacaaggcccuguacgaggccuaccugaagaucaccgaccucgagggguacgacgccaagaaccaccugaaggugaagcugaacaaagacgaggucgagcuugaugaccugaagguccccgcgagcgagaucaaggacauggugcaggccaucuucaaggaagccggcaucaacacggacauccugcacuucaacgccgagcucgacggcaaggacuucgagaaccaggcguccuaccagcuguggcaccuccucuacagcuacgagggggacgacuccaagagcggcaacgagcugcuguacaagcuccuggagaccaaguucggguucaagaaggaguacgcccagauccuugccaacgugucccucagcgacgacuacggcucccugagcacuaaggccaugcggaagauccaccccuauaucaaggagaacaaguucagcaccgccugcgagcuggcgggguaccgccacuccaagcacagccucacgaaggaggagaacgacaaccggguccugcgcgacucccuggaggugcucaagaagaauagccugcggcagcccgucguggagaagauccugaaccagaugaucaaccucgugaacgcccugcugaagaaguaccgcaccgagaaccccaacuucaaguucgacgagauccggaucgagcuggcccgcgagcugaagaagaacgccgaggagagggccaacaugaccgcgaacaucaacaaagccaagaccgagcacgagaagaucaucaagauccugaagaacgaguucggccuccccaacccgacgcgcaacgacaucauccgguaccgccuguacgaggagcugaaggccaacggcuacaaggaccucuacaccaacaucaagaucccccaggagaaguuauucaccaaggagaucgacaucgagcauaucauccccaagucccgggucuuugacgacaguuucuccaacaagacccugagcuuccgcaagaccaaccucgacaagggggagcggacggccuucgacuacauggaguccaaguucggcgccgacaagcuggaggaguauguggcgcgcguggaggaccuguacaagaacaacaucaucagcaaggccaaguaccagaagcuccugaagaaagaguccgagauuggggacggcuucgucgagcgggaccugagggagacccaguacaucgccaagaaggccaaggagauccuccugcaaaucacccccaacgugcugagcaccuccgggggcaucacggaccggcuccgcgaggacugggaccugaucaacgugaugaaggagcugaaccucccgaaguaccgcgcgcugggccugaccgagauggaggaccggaaguacgggcagcaggucgagguaaucaucgacuggacuaagcgcaacgaccaccggcaccacgccauggacgcccucaccguggccuucacgaagcacaaccacauccaguaccugaacuaccugaacgcgcgcaagaacgagaagcacaaggagcacagcaacaucaugggcauccagcagcucgagaccaucaaggucaccgacaagaacggaaacgagaagcggguguucaaggcccccaugcccaacuuccgccaggugaccaaggccuuccuggagaacauccugaucucccacaaggccaagaacaaggucgugacgaagaacaagaacaagguggccggcagcaacaagguccaggaggugcucaccccgaggggccagcugcacaaggagaccguguacgggaaguaccaguacuacguccagaaggaggagaagaucggcgggaaguucgaccuggagaccaucaagaagguggccaacccucucuaccagucccugcugaagaagcgccucgaggagaacggcggggaccccaagaaggcguucacgggcaagaacagccuggccaagaaccccauauaccuggacgacgcccagaccgagcagcuccccgagaaggugaagcuggucuggcuggagaacagcuucaguauccggaaggacaucaccccggagaacuucaaggacgagaagcucaucgacaagauccuggacgagggcgugaagagaauccugaaggagcggcuccagagcuucgggaacgacgccaagaaggccuucuccgaccuggagaagaaccccaucuggcugaauaaggagaagggcaucaccaucaagcgcgugacgaucagcggggucgcgaacgccgagccccuccacaccaagaaggaccaccugggcaaggagauccuggacaaggaggggaagcccaucccgguggacuucaucaguaccggcagcaaccaccacguggccgucuaccgggacgagaagggcaaccuccaggagaaggugguguccgucuucgaggccguggugcgcgcgaaccaggggcugcccaucaucgacaagaccuacaaccagcaccugggcugggaguuccucuucacgaugaagcagaaugagauguucgucuuccccaacgagagcaccggguucaacccgaacgacaucgaccugcuggacccgaagaacaagcggaucaucucccccaaccucuuccgcgugcagaagcuggccaccggcgacuacugguucaggcaccaucuggagaccacgguggagaccaagagcgccacgaaggauaugaccuacaagcgccugucccugaaccacaucaagaacaucaucaagguccggaucagccaccugggggacaucguguccgugggcgaguacuga

SEQ ID NO: 7970 - RNA, 4275 nt, Artificial Sequence
  Cas9 variant
augaagaggauccugggccucgaucuggggaccaacagcaucggcugggcccuggugaacgaggcugagaccgaugaggaggucuccagcaucauccggcucggggugcgcgugaacccccugacggucgacgagacccagaacuucgagaagggcaaaaguaucaccaccaacgcugagcggacucugaagcgcagcaugcggcgcaaccuccagcgguacaagcugcgccgggacgcccugguggaguuccugaaggagcugggguucaucacagacgagaccauccuguccgagcagggcaaccgcaccacguucgagaccugcaggcuccgcgccaaagcagccgaggaggagaucagccuggaggagcugucccgggugcuccugaugaucaacaagaagagaggcuacaaaagcagccggaaggucaagaaggaggaggacggggugcugaucgacggcauggagaucgccaagaaacucuacgaggaggacuuaacgccggggcagcugugcagccaguuacuggaguccggcaagaagguguuacccgacuucuaccgcagcgaccuccaggaggagcuggaccggaucugguccguucaaaagcaauuccaccccgauguguucugcgacgccgccaaggaggagaucaaggggaagaaccgcagccagaccugggccauccuggcgaacuauuucguguggaaggaggaggucgugggcuggaacgaccgggaggccaagaacgagacgaucgagaaagaaugcaagcucguaggccugaagcgcaccaccaaggguuacgagcugaagaaggagaacuaucgguggcgggcccaggcccucaccgagcagcugggccuggaggagaucgcggucgugcuccaggagaucaaugggcagaucaacgcguccagcggcuaccugggcgcgaucuccgacaggagcaaggugcuguauuuuaaccaccagacggucgggcaguaccagauggccgagcucgauaagaacccccacgccucccugcggaacaugguguuuuaccgucaggacuaccuggacgaguuugaccggauaugggagaagcaggccgaguuccacaaggaacucacugcggagcugaagaaggagauccgcgacaugaucaucuucuaccagcggcgccucaagagccagaagggacucaucagcuucugcgaguucgagcggcuggaaaucguggucgagaaggacggaaagaagcagaccaaggugauaggcugcaaggugaucccgcgcucccacccccuguuccaggaguucaaggucuggcaaacccucaacgauaucaaggugcuggggcgggagaagaagaggaacgcccugagcgccuccgagagccgggcccuuuaccccgaggagaaggagaucuuggcccgcgagcuggcgaucaaggagaacaugaagaaggccgauguccugaagcuccuguucgagaacccccaggagcuggaccucaacuucaagcagauagacggcaaccguacgggcuucucccuguucagcgccuacuccaagaugaucgagaaguacggguacgagccccuggacuucaagaagcccgccgacgagaucaucggccagcuccgcaccaucuucaccgaccugggguggaacaccaaccuguucacuauagaccucaccaaggagggcaaggagcuggagaugcagcccuacuuccggcuguggcaccuccuguauagcuucgagggggacaacaccuccacuggcaacggcaagcugaucgagaagaucaugcaguugugcgggguggagaaagaguacgccguggagcuggcgucacuguccuuccaggacgacuacggcucucucuccgccaaggccaucaagcgcaucuuacccuaccugaaggaggggaaccucuacgacgucgccugcgaguacgccggauacagacacucgaaguccagccugaccaaagaagagaucgagaacaaggugcugaaggggaagcucgaggugcugccgaaaaauucccugcgcaaccccguuguggagaagauccucagccagauggugaacgucaucaauaccaucaucgacaccuacggcaaacccgacgagauccggguggagcuggcccgcgagcugaagaaguccgccaaggagcgcgaggagcucaccaaggccauagccaaguccacgcgggagcacgaggagauccgcaagcugcugcaggacgaguucggcaugaugaacguuagccggaacgacaucauucgcuacaagcucuacgaggagcugaaggacaacgguuauaagacccuguacuccaaccaguacaucccuaaggagaagaucuuuagcaaggagaucgacaucgagcauaucaucccgcaauccaggcuguucgaugacagccuguccaacaagacccucgaguacaaggcgauaaacauagagaagggcaacaagaccgccuacgacuucgucaaggagaaguauggggaggagggccuccagcaauauaucaaccgcugcgagagccuauucaacgacaagaaagccaagcugcggaagcucaagauggagcagaaggacauucccgacggguuuaucgaccgugaccugaggaacacgcaguacaucgccaagaaggcacuggcgaugcucaacgagaucugccgccgggugguggccaccaccggguccaucaccgaccaacugcgcgaggacuggcagcuggucgacgugaugaaggagcucaaccugcccaaguacgaggcccugggcuucgucgagaccuacgaggacaaggacggccggaagaucaagcgcaucaaggacuggacgaagcggaacgaccaccgccaucacgccauggacgccuugaccgucgcguucaccaaggacgccuucauccaguauuucaauaacaagaacgccgcccaggauagcggcaaccggaaccacacgaacaucaucgggaucaagacgcgcuacuucgacaagggccgggcgcugcccccgauuccacuggagcaguuccgcauugaggccaagcagcaccucgagaagcugcuggucuccaucaaggccaagaacaaggucguaaccguaaacgugaaccggaccaagaaacgcaagggcgagaacaccaagauccagcagacgccccgcgggcagcuccaccuggagaccgucuacggcagccacaagcaguacgugacgaagaucgaaaaggugaacgccuccuucgacgccgcgaagaucgccaccgucucgaagcgggccuaccgcaacgcccugcugaagcggcuggagacguucgggaacgaccccaagaaggccuucaccggcaagaacgcucuggagaagaacccgcucuacgccgacaaguaccagaccauccgcgugcccgagaaggugcagaccgucgaguucgaaacgaucuacaccauccggaagcccguggacccagcccugaacguggacaaggucguggacgugaaaguccgcgcuauccuggagcggcgccuaaaggaguacggcggggacccuaagaaagcauucgugaacuucugggagaaucccaucuggcugaacaaggagaaggggaucuccaucaagcgggugagcauccgggggaucaacaacgcacaguccauucacguuaagaaggacaagaacggcaaucccaucugggacgagaacgggaagcagauaccgguugacuucgugaacaccggcaacaaccaccacgucgccaucuaccggaaacccguccuggacaagaagggccaggugaccuucgacgaggacggaaaccucauguacgagcuagaugaggucguggugcccuucuucgaggccguuacgcgcgccaaccuaggccuccccaucaucgacaaggacuaccgcaagagcgagggguggcaguuccuguucuccaugaagcagaacgaauacuucguguuuccgaacgagaagaccggcuucaaccccaaggagguggaccugcucaaccccgacaacuacgcaaugaucagccccaaucuguuccgggugcagaccaugagcaaagugauguacgggaacaacgucguucgggacuacaaguuccgccaccaccuagagaccacggugaaggacaugaaggaacucaaagacaucgccuacaaacaguacaagacccuguccuucgguaacagcgucgugaagauacggaucaaccacaucgggcagaucguguccguaggcgaguacuga

SEQ ID NO: 7971 - RNA, 4275 nt, Artificial Sequence
  Cas9 variant
augaagcgcauccuggggcucgaccuggggaccaacagcaucggcugggcccugguaaacgaggccgagaccgacgaggaggucaguagcaucauccggcucgggguacgcgugaacccccugacagucgacgagacccagaacuucgagaaggguaaguccaucaccaccaacgcggagcggacacugaagcgcagcaugaggcgcaaccuccagcgguacaagcugcgcagagaugcccugguggaguuccucaaggagcuggguuucaucaccgaugagaccauccuguccgagcagggcaaccgaaccacguucgagacuugccggcuccgcgccaaggccgccgaggaggagaucagccuggaggagcugagcagagugcuccugaugaucaacaagaagcguggcuacaagagcucccggaaggucaagaaggaagaggacggggugcugaucgacggcauggagaucgcaaagaagcucuacgaggaggaccugacaccagggcagcugugcagccagcuccucgaauccggcaagaaggugcugcccgacuucuaccacagcgaccuccaggaggagcuggaccgcaucugguccguucagaagcaguuccaucccgacguguucugcgacgccgccaaggaggagaucaaggggaagaaccggagccagaccugggccauccuggcgaacuacuucguguggaaggaagaggucgugggcuggaacgaccgcgaggccaaaaacgagacgaucgagaaagagugcaagcucgugggcuuaaagcggaccaccaagggguacgagcugaaaaaggagaacuaccgcuggcgggcccaggcgcucaccgagcaacugggccuggaagaaaucgccgucgugcuccaggagaucaacgggcagaucaacgcguccagcggcuaccuaggcgcgaucuccgaccggagcaagguguuauacuucaaccaccagacggucgggcaauaccagauggccgaacucgauaagaacccccacgccuccuuacgcaacaugguguucuaccggcaggacuaccuggacgaguucgaccgcaucugggagaagcaggccgaguuccacaaggagcucaccgcggagcugaagaaagagauccgggacaugaucaucuucuaccagcgccggcucaagagccagaagggccugaucagcuucugcgaguucgagcggcuggagaucguggucgagaaggacgggaagaaacagaccaaggugaucggcugcaaggugauaccccggucccacccccuguuccaggaguucaaggucuggcagacccucaacgacaucaaagugcuggggcgcgagaaaaagcgcaacgcccugagcgcauccgagagcagagcccuauaccccgaggagaaggagauccuugcccgggagcuggcaaucaaggagaacaugaagaaggccgacguccugaagcucuuauucgagaacccccaggagcuugaccucaacuucaaacagaucgacggcaaccgcaccggauucucccuguucagcgccuauuccaagaugaucgagaaguacggguacgaaccgcuggacuucaagaagcccgccgacgagaucaucggccagcuccggaccaucuucaccgaccuggguuggaacaccaaccuguucacuaucgaccucaccaaggagggcaaggagcuggagaugcagcccuacuuccgccuguggcacuuacuguacagcuucgagggggacaacaccuccaccggcaacggcaagcugaucgagaagaucaugcagcucugcggaguggagaaggaauacgccguugagcuggcgagccuguccuuccaggacgacuacggcagccucuccgccaaggccaucaagcggauucugccauaccugaaggaggggaaccucuacgacgucgccugcgaguacgcgggcuaccggcacagcaaguccagcuuaacgaaggaagagaucgagaacaaggugcugaaggggaagcucgaggugcuucccaagaacagucugcggaacccggucguggagaaaauccucagccagauggugaacgucaucaacaccaucaucgacaccuauggcaagcccgacgagauucgcguggagcuggcccgggagcugaagaaguccgccaaggagcgcgaggagcucaccaaggccaucgccaagagcacgcgcgaacacgaggagauccggaagcugcugcaggacgaauuuggcaugaugaacgugagccgcaacgacaucauccgguacaagcucuacgaggagcugaaggacaacggguacaagacacuguacucgaaccaguacauccccaaggagaagaucuucagcaaggaaauagacaucgagcauaucaucccgcagucccgccucuucgacgacagccuguccaacaaaacccuggaguacaaggcaaucaauaucgagaagggcaacaagaccgccuacgacuucgucaaggagaaguacggggaggagggccuacagcaguacaucaaucggugcgagagccuguucaacgauaagaaggccaagcugcgcaagcucaagauggagcaaaaggauauccccgacggcuucaucgaccgggaccugcgcaacacgcaauacaucgccaaaaaggcccuggcgaugcucaacgagaucugccggcgcgugguggccaccacuggguccaucaccgaccagcugcgggaggacuggcagcuggucgauguuaugaaggagcucaaccugcccaaguacgaggcccugggcuucguggagaccuacgaggauaaagacgggcgcaagaucaagcggaucaaggacuggacgaagcgcaacgaucaccggcaccacgccauggacgcgcucaccgucgcguucaccaaggacgccuucauccaguacuucaacaacaagaacgcugcccaggacagcgguaaccgcaaucacaccaacaucaucggaaucaaaacacgguacuucgacaagggccgcgcguugccaccgaucccccuggagcaguuccggaucgaggccaaacagcaccucgagaaguugcugguguccaucaaggccaagaacaagguggucaccguuaacgugaaccgcaccaagaagcggaagggcgagaacacgaagauacagcagacgccccgcgggcaacuccacuuggagaccgucuacggcagccacaagcaguacgugaccaagaucgagaaggugaacgccuccuucgacgccgcgaagaucgccaccgucucaaagcgggccuaccggaacgcccugcucaagcgccuagagacguucgggaaugaccccaagaaggcguucaccggcaagaacgcgcuugagaagaacccgcucuacgccgacaaguaccagaccauucgcguccccgagaaggugcagaccgucgaguucgagacuaucuacacuauccgcaagccaguggaccccgcccugaacguggacaaggucguggacgugaagguccgagccauccuggagcggcgcuuaaaggaguacggcggggacccgaagaaggccuucgugaacuucugggagaacccgaucuggcugaacaaggagaaggggaucuccaucaaacgcgugagcauccgggggaucaacaacgcgcaguccauccacgucaagaaggacaagaacggcaaccccaucugggacgagaaugggaagcagaucccgguggauuucgugaacaccggcaacaaccaccacgucgccaucuaccggaagcccguacuggacaagaagggccaggugaccuuugacgaggaugggaaccucauguacgagcuggacgaagucgugguccccuucuucgaggcugucacgcgggccaaccugggccuccccauaaucgacaaagacuacagaaagagcgagggguggcaguuccuguucuccaugaagcagaacgaauacuucguguucccgaacgagaaaaccggcuucaaccccaaggagguggaccuguugaaccccgacaacuacgcgaugaucagccccaaccuguuccggguccaaaccaugagcaaggugauguacgggaacaacgucgugcgcgacuacaaguuccggcaccaccuggagaccacggugaaggauaugaaggagcucaaggacaucgccuacaagcaguacaagacccuguccuucggcaacagcgucgugaagauccgcaucaaccacauugggcagaucguguccgucggcgaguacuga

SEQ ID NO: 7972 - RNA, 4278 nt, Artificial Sequence
  Cas9 variant
augcgccggaacauccugggccucgaccuggggaccaccagcaucggcuucgccaaggugaucgaggacgaggacuaccaaaauuccgccgucgagcugauaggggugcgcgugaacccccucacgaccgaugagcagaccaacuucgagaagggccggccggucucugugaacgcggaccgcacccugaagcgggggaugcgccggaaccuggaccgcuaccagcuccggcgccaccaccugaucgaggugcugaaggccaaccacaucaucacggucgacaccaagcucgccgaggacggcaagaacaccacccaugccacguacgccgugcgggcgcuggccgccacagccgagaucccccuggaggcguucgcccgcgugcuccuggccaucaacaagaagcggggcuacaaguccagccgcaaggccaagaacgaggacgaggggcagcuaaucgacggcauggccgucgcgaagcggcucuacgaggagaaccugacccccggacagcuguccuaccuccugcugaaagagggcaagaaguaccuccccgacuucuaccgcagcgaccugaacgccgagcuggacaaggugugguccuuccagaagcaguucuacccggagaucuuaaccgaggaguucaagaagcaccuggaagggaagggccagcgggccacgagcgccgccuucuggggccaguacggguucaacaccgcagagaacaagggcucccgcgaggagaagaagcugaaggccuaccaguggcggagcgaggcaguggaucagcagcucaccaaggaggaggucgccuacgugauuacagagaucaauaacgaccugaacaaguccagcggguaccugggcgccaucuccgaccgcagcaaggagcuguucuucaacaagcagacggugggccaguaccuguaccagcagcugaagcagaacccccacacccggcucaaggggcaggucuucuaccgccaggacuaccuggacgaguucgagaccaucugggagacacaggccaaguuccaccccgagcugacggccgcccucaaggaggagauccgcgacgugaucaucuucuaccagcggaagcugaagucccagaagggccugaucagcuucugcgaguucgaguccaaagagaucgaagucgagaagaacgggcucaagaucaagaagcgcaucggccuucgggucgcccccaagagcuccccgcuguuccaagaguucaagaucuggcagguccucaacaacuuggaguuccgcaacaagagcagcaaggagguguuugugcccgacaugaccgcaaagcagcagcuguucgacgagcucaacaucaaggggaaccugcuggcguccgaggccaucaagauccucggcuacaagaccaaggacugggaggccaacuaccacacccuggagggcaaccggacgaacaagagccuguacgacgccuaccugaagauccucgagcuggagggguaugacgaggaucugcucaagcuguccggcagcgacgacaucgacguguccaagauugagaaguccgcgagcgagaucaagcagauggugcacgccgucuucgaggugcuggggaucaacagcaccauccucgacuucgacgccgaggccgacggcaaggccuucgagcagcagacugcguaccgccuguggcaucuccucuacuccgccgaggacgacaacaagaaguaccugcaggaggacaucuucaucuacgggcaugacaacaucggccugaagaagaaacuuugcgagcgguucggcuuccgccccgagcacaccaagauccuggucaacguggccuucagcggggacuacggcucgcucagcuccaaggccaugcggaagaucuaccccuuuaucaaggagcucacguacgacaaggccugccgcgaggcgggauaccggcacagcgccagcagccuguccaaggaagagaucgccacccgcccgcugcagaagcggcucggccugcugaagaagaacgaguugcgcagccccguggucgagaagauccugaaccagauggugaacguggucaacgcccugaucgacgacgagaacaagcggcgcaaggcccgggggcucuccgacgacuuucacuucgacgagauccgcaucgagcuggcgcgggagcugaagaagaacgccaaggagcgcgccgaaaugaccaccaacaucaacgccgcgaagcagcuccacgagaagaucaucaagauccugcagacgcaguucggcgugagcaaccccagccgcaacgacaucauccgguacaagcuguacgaggagcucaagaacaacggcuacaaggaccuguacaccaacaccuacaucuccccggacaucuuauucagcaagcagaucgacauagaccacauuaucccgcagaugucucucuucgacgacagcuucuccaacaaaacaguggucuuccgcaaggacaaccaggacaaggggaacaagacggccuacgacuacauccugggcaaguacggggagcuggcccucgaagaguacaucagccggaucaccucccuguucgagcugggcaaaaagaacaaggaggagggcaucaacaaggccaaguuccagaagcugcagaagcgccugaucgacaucggggacggcuucaucgagaaggaccugcgggagagccaauacaucgccaagaaggcgaagaacaugcucuacgccaucugccgcuccgugguggccaccagcggggagaucaccgcccggcugcgcgaggacugggaccuggucaacgugaugcaggagaucaaccuccccaaguuccgugcccugggccugaccgagaugguggagaagaaggacggaggccagaaggagcgcaucauagacuggacgaagcggaacgaccaccgccaccacgcgauggacgcccucaccaucgcguucacccggcauucccacauccaguaccugaaccaccugaacgcccgcaaggacgaggccagcaaguggcaccccgucguguccaagaucgaggagaaggagaccgaccucguguacgacgaccugggcaaccggaagcgccgguucaaggcgcccaugccgaacuuccgcgaggucgugaaggagcaccuggagaacgugcucaucagccacaaggccaagaacaaggucgugacgaagaacaagaacaagaucaagaccgccaagggggagaagaucaagaccgaguuaacgccccggggccagcugcacaaggagaccaucuacgggcgcuaccgguacuacgaguccaaggaggagaaggugggccccaaguucgacgccgagaccaucgggauggucguuaacccccaguaccgcaagcuccugcuggagcgccucaccaccaacggcaacgacccgaagaaggcguucggcgggaagaacacgcuuagcaagaacccccuguacaucgacgaggccaagcaggagcucuuacccgagaagauccugcuccgguggcugaacgaugauuacuccauccgcaaggacgugacccccgagaaccugaaggacguaaagaccaucgagaaagugcucgacgagggcaucaaaaagauccugcugaagcggcucguggauuucggaaacgacccgaagaaggccuucagcgaccuggacaagaacccaaucuggcugaacgaggccaagggcaucaccaucaagcgcgucacgaucagcggggugaagaacgccgaggcgcuccacuacaagaaggaccacuucggcaacgccauccugaacgagaacggcaagcugaucccuuccagcuucguguccaccgggaauaaccaccacguggccaucuaccgggacgccgagggcaaccuccaggagcguguggugucccuguucgacgccguccaacuggugaacgcgggggaggccgugaucgaccgggaguacaacaagggcaucggguggcaauuccucuucaccaugaagcagaacgagauguucgucuucccgaacgagaagacaggcuucgaccccaaggagaucgaccugcugaacacggacaaccgcaagcucaucuccccuaaccuguuccgggugcagaagauagccagcaagaacuacuucuuccgccaccaccuggagaccaacguggaggagcgcaaggagcucaaggacaucgucuacaagccccagcugggacugaacgccaucaaggacguggugaagguucgcaucaaccaccucgggaagaucaucuccgugggcgaguacuga

SEQ ID NO: 7973 - RNA, 4281 nt, Artificial Sequence
  Cas9 variant
augccccgcaagaacauccugggucucgaccugggcaccaccaguauaggcuucgccaagauuaucgaggacgacgacuaccagugcuccagcguggaacugaucggcguccgggugaacccacucacuaccgaugagcaaaccaacuucgagaagggcaagcccguguccguaaacgccgaucgcacccuuaagcgggguaugcgccggaaccuggaccgauaucagcuccgucgcgacuaccuuaucgagauccugcggacgcaucacaucaucaccgcggauacuaagcucgccgaggacggcaaaaacaccacgcauaccaccuacgccuuacgggcucuggcagcgaccgccgagaucccccucgaggccuucguuaggguccugcuggccaucaacaaaaagcgcggcuacaagagcagccgcaaggcgaagaacgaagacgaggggcagcucaucgacgguauggccauugcgcgccggcucuacgaggagucccugaccccugggcaguucuccuaccagcuccugaaagagggcaagaaguaccugccggacuucuacagaucugaccucaacacugagcuaaauaagguauggaauuuccagaagcaguucuaccccgagauauuaacagacgaguucaagcgccaucuagaggggaagggccaacgcgcaaccgccguugcauucuggggccaacaugguuucuccauggcggaaaacaagggaagccgggaggaaaagaagcuacacgccuacaaguggcgcagcgaggccgcccacaagcaguugacgaaggaagaggucgcguucgucaucacggagaucaacaacgaccuaaauaaaagcuccggguaccugggugccaucagcgacagaucaaaggaguuauucuuuaacaagcagacugugggccaguaucuacaccaacaguuaaaggagaacccccacaccaggcugaagggccagguguucuaccgccaggacuacuuagacgaguucgagacaaucugggagaugcaagccaaauuuuacagcgcucugacacuggagcucaaggaggagguccgugauguggugaucuucuaccagcgcaagcuaaagucccagaugggguugauaagccucugcgaauuugagagcaaggagaucgagaucgagaagaauggggaaaaggcgaagaagcgaaucggccugcgcguggcgccaaagucaagcccgcuguuccaggaguucaagaucuggcagguucucaauaaccuggaguuccgcaacaagaagacaaaagaggucuuugugcccgagauggcugcuaaacagcagcuuuucgacgaacucaacaucaaggggaaccugcuggcguccgaagccaucaaaaucuuaggcuacaagaccaaggacugggaggcgaacuaccacacauuagagggaaaccgcacaaacaagagccuguacgacgcaugguuaaagauccuagagcuggaggguuaugacgagaaccuguugaagcuaucuggcagcgacgacauugacguguccaagaucgagaagcccgcacuugagauccggcagauggugcucgccgucuucgagguucuggggaucaguggcgcgauccuggacuucgaugcugaggccgacgggaaggccuucgaacagcagccagccuaucagcucuggcaccuccuuuacuccgcugaagacgacggcaagaaauacagccaggaggacaucuucaccuacggccacgauaauaucgggcuuaagaagaagcuaugcgagaaguucggauuccguccggaacacaccaagauucuggugaacgucguuuucuccgacgacuaugggaaccuaagcuccaaggccaugcggcgcaucuaccccuucauaaaggagcugacguacgacaaggcuugcgccgaagcaggcuaccggcacagcgcggccucccugaccaaggaggaaaucgccgcccgcccacuccagaaccggcuggaccugcucaaaaagaacgagcugcggagucccgucgucgagaagauccuaaaccaaauggugaacguagucaacacccucguggacgacgaaaaccagaaccggaaggcccgcgggcugagugaggacuuccauuucgacgaaauccggaucgagcuggcgcgcgaacucaaaaagaacgccaaggagagagcagagaugaccacgaacauaaauaccgccaagcagagccacgagaagaucauccgcauccugcagaccgaguucggugucccgaaccccucccgcaacgacaucguucgguacaagcuauacgaagaauuaaagaacaacggcuacaaagaucuguauaccaacacguacaucagcagagacauccuguucuccaagcagauagacguggaccacaucaucccccagaugagccucuucgaugacagcuucuccaacaaaaccguagucuuccggaaggauaaucaggauaaggggaacaagacggccuaugacuacauacuuggcaaauacggggaacaggcccuggaggaguacaucagccgcauaaccucccucuucgagcuggguaagaagaacaaggaagagggaaucgggaaggccaaguuccagaagcuacagaagcgcuugguggacaucggcgacggguucaucgagcgugaccuacgggagagccaauauaucgccaagaaggccaacaauaugcuguacgcgaucugccguuccgucgugagcaccucaggcgagaucacggcgcggcuccgagaggauugggaccuggugaacgucaugcaagagaucaaccuaccgaaauucagggcccucgggcuaacggagauggucgagaagaaggauggcgcccagaaggagcgcaucaccgacuggaccaaacggaacgaucaccgccaccacgcaauggacgcguuagcaaucgccuucacgcggcacagccauauccaguaccucaaccaccugaaugcccgcaaggacgaagcgaacaaguggcacccgguugucucaaagauagaggagaaagagacuguguugaucuaugacgaccucggaaacagaaagcgcaaguucaaggcgccaaugcccaacuuccgggagguggucaaagagcaucucgagaacguucugaucagccacaaggccaaaaauaagguggugacuaagaacaaaaacaagaucaagacuguucgcggggagaaggugaagacggagcucacgccccggggccagcugcacaaggagaccaucuacgggcgcuaccgcuacuacgaguccaaggaagagaagaucggcccgaaguucgaugcggagaugaucgggauggucaccaacccacaguacaaaaagcugcuccuggagcggcuggccgcgaacggcaacgaucccaagaaggccuuuuggggcaagaaugcucucaacaagaacccccuguauguggacgaggcccgccaggaacugcucccggagaagauucugcugcguuggcucaacgacgacuacagcauucgcaaggacguaaccccagagaaccugaaagacaucaaaaccaucgagaagauucuggacaaagggguuaaaaagaucuuacugaagcggcuggccgacuucgggaaugaccccaaaaaggcuuuuagcgaucucgacaaaaaccccauuuggcagaacgaggccaaacgcaucgccaucaagagggugaccaucagcgguaucaagaacgccgcgccccugcaccacaagaaagaucaccugggcaacgacaucuuggacgaaaaggggaagcaaauccccaguagcuucgucuccaccggcaacaaccaccacguugcgauauaccgcgacgccgagggcaaucugcaggagcggguggugucccuguucgacgcaguccagcucguuaacggcggagagcccgugaucgacaaagaguacaacaaggggaucggauggcaguuccuguuuacaaugaagcagaacgagauguucgucuucccugacgagaagaccggcuucaacccuagagagguggauuuacucaguaguggcaaccguaagcugaucagcccaaaccuuuuccgcguacagaaacucgcauccaagaacuacuucuuucggcaccaccuggagacuagcguggaggaaaagaaggaguuaaagaacaucgcguauaagccccagcucggccugaacgcgcucuccaacaucgugaagguacgcaucaaccacaucggagagaucguuucugugggggaguacuga

SEQ ID NO: 7974 - RNA, 4281 nt, Artificial Sequence; identical to SEQ ID NO: 2174
  Cas9 variant

SEQ ID NO: 7975 - RNA, 4281 nt, Artificial Sequence
  Cas9 variant
augaagcacauccugggccucgaccuugggaccaacaguaucggcugggcccugaucaagcaggacuucgagaacaagcagggggagauccucggcauggguucgcgaaucauccccaugagccaggauauacugggugacuuuggcaaggggaacuccgugagccagaccgccgagaggacgaaguaccgauccguccggcgccugcgggagcgauuucuccugcggcgcgagcggcugcacaggauccucaacguuuugggcuuccugcccgagcacuacgcgagucagauagacuucaccaagcgguucgggaaguucaaagaggagacugagcccaagcucguguacaguaaugagggcuucauauucaaaaagagcuucgaggagaugcugagcgacuucaagacucaccagccacagcugcucgaggacaacaagaagaucccauacgacuggacgaucuacuaccuccgcaagaaggcccugagccgcaagaucgagaaggaggagcucgccuggauccugcugaacuucaaccaaaagagaggguacuaccagcuacggggcgaggaggaggaggagaacccaaacaagcugaucgaguucuacucacugaagaucgucgacgugcucgccgacgagccucagaaaggcaagagcgacaucugguauucccuuauccuggaaaacggguggaucuacagacggagcuccaaaacgccccucuucgacuggaaggagaagacccgagacuucauagugaccaucgaccugaacgacgacggcucagucaaaaccgacaaggaggggaacgaaaagcgguccuuucgcgcucccggcgagaacgacuggacccuggugaagaagaagaccgagcaggagaucgacagcucccggaagacagugggcacuuacaucuacgagacgcuccugaaaaacccgaagcagaagaucaaggggaagcugguacgcaccaucgagcgcaaauucuacaagaccgagcucaagcaaauccuggagaagcagaaggaguuccaccccgagcugcggcaggacgaccucuauagcgacugcgugcgcgaguuauacaagaacaacgaagcgcaccagcugacgcucagcaaaaaggacuucgugcaucuguucauggaggacaucaucuucuaccagcggccccugggaucccagaaguccagcaucagcaacugcacgcuagaguuccgcaaauauaaggacgagaacggaaccgagcacacccaguaccugaaggccaucccaaagaguaacccguacuaccaggaguuccguaucuggcaguggauguacaaccugaacaucuacaagaaagaggaugacacgaacguaaccaaggacuucuuaaacaccaaggccgauuuugagagccuguuugaguuccugaacaaucgcaaggagguggaccagaaggcccuccugaagcacuucaagcugaacgacaagacccaccgguggaacuacguagaggacaagaaguaccccugcaacgaaacuaagacaaugauccuuucccgccuagacaaaguagagaacaucucagaugacuuccugacccgggagauggagcagaagaucuggcauaucaucuacuccgugaacgauaagguggaguacgagaaggcgcucaagagcuucgccggcaagaacaaccucgaggacaacuccuucuucgaggcguucaagaaguucccgcccuuuaagagcgaguacggggcuuucagcgagaaggccaucaaaaagcugcugccccucaugcgcaugggcaaguucuggaacuacaauaacauaagcgagcaguccaaaucgcggauccaaaagaucaucaccggcgaguacgacgagaacaucaaggacaagguacgcgagaaggcgauccaccugacgaccgagaccgacuuccaggggcugcagcucuggcuggugcaauacauuguguacggucggcacuccgaggccgccaugcuggggaaguggaacucagcagacgaccucgaggaguuccugaaggaguucaagcagcacucccugcgcaaccccaucgucgaacagguaaucaccgagacccuccggguggugaaggacaucuggcagaaauauggcaacggagccaaggacuucuuccgcgagauccacaucgagcuaggcagagagaugaagcugcccgcggaggaacgcgagcggcucacccgccagaucagcgagaacgagaacacaaacuuccgcaucaaggcccugcuggccgagaugauggaugacaacagcguugagaacguccggccauucuccccaaugcagcaggagaucuugaagaucuacgaggagggcgugcugaacagcgacauugagauugaagacgacauccugaagaucuccaaaaccgcccagcccagcuccuccgaccucaaacgcuacaagcuguggcuggagcagaaguacaaaucccccuacacggggcagaucaucccccuaaacaagcuguucaccccggaguacgagaucgagcacaucaucccucagagccgguacuuugacgauaguuucaccaacaagaucaucugcgagagcgccgugaacaagcugaaggacaacuauaucggccucgaguucauuaaaaagcucggcggguccaucgucgagugugggaacggcaagagcguggccauucugaagcacgacgccuacgaggacuucauaaagaagcacuaugccaacaaccgcucaaagagaaauaaacuucugcuggaggacauccccgagaagaugauugagcgccagaugaacgacacacgguacaucagcaaguacaucuccggugugcucagcaauauagucagaguggaggacgggaccgacgagggcgucaacuccaagaacaucguccccgggaacggcaagaucacgacccagcugaagcaggacuggggccugaacgacguguggaaugacuuaauccugccccgguucgagcgcaugaaccaccugacaaacagcaccgacuucacggccuggaacgaaaaccaccagaaguuccuccccaccgugcccgucgaguucagcaaggguuuuuccaagaagcgaaucgaccaccgccaccacgcccuggacgcgcuggugaucgccugcgccacaaaggaccacgugaacuuacugaacaaccagagcgccaagucugacaccaagcgguacgaucugaagaagaaacuuaugaaguucgagaaggucgcuuacaaccacccucaaacgggcgagcgcaucgagcgggaggcccccaagcaguuccugaagcccugggaaaccuucaccaucgaugcaaagaaccaccucgagaccaucaucgugagcuuuaagcagaacuuacgagugauaaauaaggccacgaacuacuacgagaaguacgucgagaaggaggggaccaaggugaaggaacgaguggaacagaagggcaccaauugggccauccguaagcccaugcacaaggagacagucuccggaaagaucgaccugccgcggaucaaggugcccaagggcaagauucugacugcaacccgcaaguccuuggacaccucuuucaacuuaaagaccaucgggagcaucacggacaccgggauccagaagauccugaagaacuaccuccaauacaaggacaacaacccugagcuugccuuuucccccgagggcaucgaggacaugaacaagaacaucgagaaguucaacaacgggaaggcccaucagagcaucuccaagguccgggucuucgagcugggcagcaaguucccgcucgggcaguccgguaacaagaaagagaaguacguggaggcggccaaaggcaccaaccuguucuucgcaaucuaccaggacaaaaacgggaagcgcuccuaugagaccaucccccugaaugaggugaucgagcgccagaagcagggccucuccgucguggaccugaagggaguggaugacuuuuaccugucacccaacgaccucgucuacgugcccuccgaagacgagcuggaaaacaucagcaugaucgauuucaacaagauguccagcgagcggaucuacaaggugguuagcuucacgggcaaccagaucuucuucgugagacaggacaucgccacuucgguggucaacaaggccgaguucagcacccugaacaagauggagcgggcaaucgacgggaccaugauuaaggagacgugcguuaagcuccagauagaccgccugggcaacaucuccaagaucuga

SEQ ID NO: 7976 - RNA, 4281 nt, Artificial Sequence; identical to SEQ ID NO: 2176
  Cas9 variant

SEQ ID NO: 7977 - RNA, 4281 nt, Artificial Sequence
  Cas9 variant
augaagaacauccugggccucgaccuagggaccaccagcauaggcuucgcccacaucguggaagacgagaacaaggagaaguccgagaucaaggagcuggggguccgcaucgugagccucacgaccgacgagcaguccgacuucgagaaaggcaagagcaucaccaccaacgccaaccggacgcugaagcacggggcgcgccugaaccucgaccgguaccagcagcgccggaaguaccugaucgaccugcuacagaaggccaaccugaucacccccuccagcauccuggccgagaacggcaaaaacaccacccacuccacguggcagcuccgcgccaaagccgugaccgagcggaucgagaaggaggaguuugcgcgcauccugcuggccaucaacaagaagcggggcuacaagagcucccgcaaggccaagaccgaggacgaggggcaggccaucgacggcauggcgaucgccaagcggcucuacgacgagaaccugaccccggggcagcugagccuccagcugcugcagcagaauaagaagcuccugcccgacuucuaccgcuccgaccugcagaaggaguucgaccucgucuggaacuuccagaagcaguucuaccccgacauccugacggacauuuucuacaaggagcugcagggcaaggggaaggacgccaccagcaaggccuucuccaagcgguaccacuucgacaccaccgagaacaagggcagcaaggaguccgugcgccuccaggccuaccaguggcgggcggaggccaucagcaagcagcuuuccaaagaggagguggccuacguccugacggagaucaacaacaaccuuaacaacgccagcggcuaccugggggccaucuccgaccgcagcaaggagcuguacuucaaccgacagaccgugggccaguaccucuacgcuaagcugcaggagaaccgccacaauagccugaagaacaagguguucuaccggcaggacuaccucgacgaguucgagcgcaucugggagacccaggccuccuuccacaaggagcugaccgacgagcugaagaagcagauccgggacgucgugaucuucuaucagcgcaagcccaagagccagaaggggcucaucucuuucugcgaguucgagagcaaggagaucgagaucgagaaggacggcaagacgaucaccaagaacaucggcgcccgcguggucccgaaguccagcccacuguuccaggaguucaagaucuggcagauccugaacaacgugaucugcaagcggaaggggauccgcaagaagaagaucuccgccaagacuacccagcucgaccugcugaacgagagcucccagacgaucuucagccucgacauggagugcaagcagcuacuguuugacgagcucaaccugaagggcgacuugaaguccgacaaggugcugaagcugcugggguacagcccucaggagugggagaucaacuacaaccagcuggagggcaaccggacccagaaggcccucuacgaggcguaccugaagaucguggagauggaggcucacgacgugaaggacauccugcagaucaaguccgccaaggacgacuggagccucgacgagagcccucuguccgccuccgagauccgcgagaaggugaaagccaucuuccagacccuggguaucugcaccaagaucuuauacuucgacccgcugcugcccgucaaggaguucgaggagcaggacagcuaucagcucuggcaccuccuguacuccuacgagagcgacgacagcacguccggcaacgagacccucuaccggauccuggagaagaaguacgcguucaagcgcgagcacgcccggauccuggccaacguggcccuccaggaugacuacggcagccuguccaccaaggcgauccgcaagaucuaccccaacaucaaggagaaccaguacagcaccgccugcgagaaggccggguacaagcacuccaaacugagccucacgaccgaggaacuggaggcccgggagcugaaaaacaucaucccccuccugaagaagaacgcccugcgcaacccgguggucgagaagauccucaaccagaugaucaacguggugaacgcccugaucgagaagaacuccgagcgggacgcagaggguaagaucaccaaguacuuccauuucgaugagauccgcaucgagcuggcccgggagcucaagaagaacgcccagaagcgcuacgagaugacccaaaacaucaacaaggccaagcuggagcaccagaagaucagcgagauccugcagaaggaguucgggaucaagaaccccacgaaguccgacaucauccgguaccgccucuaccaggagcuggagcacaacggcuacaaggaacuguacaccaacgcgcccaucgcgcgugacaugcuguucagcaagaacaucgagaucgagcacaucguccccaaggcccgcguguucgacgacuccuucagcaacaagacccugaccuuccaccggaucaacagugacaagggggaguacaccgccuucgacuacaucacgucacugaacuccgaggaggagcucaaccaguaucugacccgcgucgagaacgccuacaagaccaagagcaucuccccgaccaaguacaagaaccugcucaagaaggcgagcgagaucggcgacgacuucaucaaccgcgaccugcgggacacgcaguacaucgccaagaaggccaaagagauacuguuccaggugacuaagaacgugcucagcaccuccggcagcaucaccgaccgccugcgggaggacugggggcugguggacgugaugaaggaacucaacaugccgaaguaccagagccugggccugacggagguggaggagcgcaaggacgggaacaagguaaccgugaucaagaacuggaccaagcgcaacgaccaccgucaccacgccauggaugcgcucaccguugccuucacgaagcccagcuacauacaauaccugaaucaccugaacgcccggaaggacgagaacaacaagaacuacagugucauccucgccauugaggagaaggagaccaucaaggugcccaccaacaacggcaagaacaagcgcguguucaucgagccgaucccaaacuuccggcaggucgcgaagaagcaccuggaggagaucuucaucagccacaaggcgaagaacaagguggugaccaagaacacgaacaagcccgccgggaccgacaagcagcaaaucacccugacgccccgcggccagcuccacaaggagaccaucuacggcaaguaccaguacuacaucaacaaggaggaaaagaucggggucaaguucgacgagcggaccaucgccaagguauccaacccgguguaucgcgaggcccugcugaagcggcuccaggccaaugacaacgaccccaagaaggcguucgccggcaagaacgcccucagcaagaaccccaucuaccuggacgaguccaagaccaagacccuccccgagaaggucaaccugacguaccuggaggaggacuucagcauccgcaaggacaucuccccggacaacuucaaggaccucaagagcaucgagaaggugaucgaccaaggggugaagcggauccugaucaaacgcuugcaggccuacgacaacgaccccaagaaggcguucgucgaccucgagaagaaccccaucuggcugaacaaggagaagggcaucgcgaucaaacgggugaccaucuccggcgugaacaacgcccagccgcugcacaucgggaaggaccaccucggcaagaccacccugaacaaggaggggaaggagauccccgucgacuacgugagcacgggcaacaaccaccacguggccaucuaccgcgacaaggaggggaaccugcaggagcagaucgucuccuucuucgacgccguggugcgggcgcagcagggcauccccaucaucgacaagaccuacaagcaggcggagggcuggcaguuccucuucacaaugaagcagaacgagauguucgucuuccccaacgccaccacgggguucaacccggcugagaucgaccugcucgaccccaaaaacaagaagcucaucagccccaaccuauuccgcgugcagaagaucgccaccaaggacuacuucuuccggcaccaccuggagaccaacguggagaccgacaacauucucaagaacgucacguggaagcgcgaaggccugucugggcugaaggacaucgugaaggugcgcaucaaccaccucggcgacaucguaagcaucggggaguacuga

SEQ ID NO: 7978 - RNA, 4281 nt, Artificial Sequence
  Cas9 variant
augaagaacauccugggccucgaucuggggaccaccagcaucggcuucacgcacaucguggaggacgagaacaaagagaaguccgagaucaaggagcuggggguccgcaucgugagccucaccaccgacgagcaguccgacuucgagaaaggcaagagcaucuccaccaacgccaaccggacgcugaagcacggggcucgccugaaccucgaucgguaccagcagcgccggaaguuccugaucgaccugcuccagaaggcgaaccugaucaccagcuccagcauccuggccgagaacggaaagaacaccacccacuccacguggcagcuccgcgccaaggccguaaccgagcggaucgagaaggaggaguucgcccgcguccuccuggcgaucaacaagaagcgaggcuacaagagcucccgcaaggccaagaccgaggaugaggggcaggccaucgacggcauggccauugcgaagcggcucuacgacgagaaccugacccccgggcagcugagccuccaacugcugcagcagaacaagaagcuccugccggacuucuaucgcuccgaccugcagaaggaguucgaucucguguggaacuuccagaagcaguucuaccccgacauccugacggacagcuucuacaaggagcugcagggcaaggggaaagacgccaccagcaaggccuucagcaagcgguaccacuucgacaccgccgagaacaagggaucccgcgagagugugcggcuccaggccuaccaguggcgcgcggaagccaucuccaagcaacugagcaaggaggaggucgccuacguguuaaccgagaucaacaacaaccucaacaacgccagcggcuaccugggggccaucuccgaccggagcaaggagcuguacuucaaccgccagacgguuggccaguaccucuacgcccagcugcaggagaacaagcacaacucccugaagaacaaggucuucuaccggcaggacuaccucgacgaguucgagcgcaucugggagacccaggccagcuuccacaaggagcugaccgaggagcugaagaagcagauccgggacgucgugaucuucuaccagcgcaagcucaagucccagaaggggcugaucagcuucugcgaguucgaguccaaggagaucgagaucgagaaggacggcaagaccaucacgaaguccaucggcgcccgcgucgugcccaaguccagcccccuguuccaggaguucaagaucuggcagauccucaacaacguaaccuguaagcggaaggggauccgcaagaagaaguccagcgccaaguccaccgagcuggaccuguucaacgagccgagccagaccaucuucucccucgacauggagugcaagcaacugcuguucgaggagcucaaccuuaagggcgaccucaaguccgacaagguccugaagcuccugggguacagcccccaggagugggagaucaacuacaaccagcuggagggcaaccggacgcagaaggcccucuacgaagcguaccugaagaucguggagauggaggcccacgacguuaaggacauccugcagaucaagagcaccaaggacgacugggcccucgaggagagcccccugagcgccagcgaaauccgcgaacgggucaaggcgaucuuccagacccuggggaucugcaccaagauccucuacuucgacccccugcugccggugaaggaguucgaggagcaggacuccuaccagcucuggcaucuccuguacagcuacgaguccgacgauagcacgucuggcaacgagacccuguaucgcauccuagagaagaaguacgcguucaagcgggagcacgccaccauccuggccaacgugacccuccaggacgacuacggcagccuguccacgaaggccauccgcaagaucuaccccuauaucaaggagaaccaguacagcaccgcgugcgagaaggccggguacaagcacuccaaguugagccucaccaccgaggaacuggaggcccgugagcugaagaacaucaucccccuccugaagaagaacgcccugcgcaaccccgucguggagaagauccuuaaccagaugauaaacguggucaacgcgcuaaucgagaaaaacuccgagcgggacgcggagggcaagaucacgaaguacuuccacuucgaugagauccgcaucgagcuggcccgggagcucaagaagaacgcccaggagcgcuacgagaugacccagaacaucaacaaggccaagcuggaacaccagaagaucagcgggauccugcagaaggaguucggcaucaagaacccgaccaaguccgacaucacccgguaccgccucuaccaggagcuggcccacaacggguacaacgaccuguacaccaacacguacauccccaaggagcuccuguucagcaagaacaucgacaucgagcacaucguguccaaggcgcgggucuucgacgacagcuucuccaacaagacccuggccuuccgcgaguucaacaucaagaagggcgagagcacggcguucgacuacaucaccagccucaacaacgaggaggaguugaaucaguaccugaaccggguggagaacgccuacaagacgaagaacaucucccccgcaaaguacaagaaccuccugaagaaagcgagcgagaucggcgacggguuuaucaaccgcgaccugcgcgacacccaguacaucgccaagaaggccaaggagauccucuuccaggugaccaagaacguccuguccaccagcggcuccaucacggaccggcugcgcgaggacugggggcucguggacgugaugaaggagcugaacaugcccaaguaucagagccugggccucaccgaggucgaggagcggaaggaggggaacaaggugaccgugaucaagaacuggaccaagcgcaacgaucaccggcaccacgccauggacgcgcugacggucgcauucaccaagccguccuacauccaguaccugaaccaccucaacgcccgcaaggacaagaacaacaagaacuacagcgugauccuggccaucgaggagaaggagaccaucaaggugccaaccaacaauggcaagaacaagcgggucuucaucgagcccauccccaacuuccgccagguggccaagaagcaccuggaggagaucuucaucucccacaaagcgaagaacaagguggucacgaagaacaccaacaagccggccggcaccgacaagcagcagaucacccucacgccccgggggcagcugcacaaagagaccguguacggcaaguaccaguacuacgugaacaaagaggagaagaucgggguuaaguucgacaaggagaccaucgccaaggugaguaaccccguguaccgcgaggcccugcucaagcggcugcaggcgaacgacaacgaccccaagaaggcguucgccggcaagaacgcccuguccaagaacccgaucuaccucgacgaggccaagaccaagacgcugacggagaaggucaaccugaccuaccucgaggaggacuucagcauccgcaaggacaucucccccgacaacuucaaggaccucaagagcaucgagaaagugaucgaccagggcguaaaacggauccugaucaagcgccugcaggacuacgacaacgaccccaagaaggccuucgucgaccuggagaagaaccccaucuggcuaaacaaggagaaggggaucgccaucaagcggguuaccaucuccggugugaacaacgcccagccgcuccacaucgggaaggaccaccugggcaagacgacccugaacaaggaagggaaggagauccccgucgacuacgugagcaccggcaacaaccaccacguggccaucuaccgcgacaaggagggcaaccuccaggagcagaucgucuccuucuucgaggccguggugggggcgcagcagggccugcccaucgucgacaagaccuacaagcaggccgagggauggcaguuccuguucacgaugaagcagaaugagauguuuguguucccgaacgaggccaccggcuucaaccccgccgagaucgaccuccuggacccuaagaauaagaagcagaucucucccaaccuguuccgggugcagaagaucgccaccaaggacuacuucuuccgccaccaccucgaaaccaacgucgacacggacaacgugcugaaaaacaccaccuggaagcgggagggguuauccggccucaaagacauugugaagguccgcaucaaccaccugggcgauaucgugagcaucggggaguacuga

SEQ ID NO: 7979 - RNA, 4284 nt, Artificial Sequence
  Cas9 variant
augaaaaagauccugggccucgaccuugggaccagcaguaucggcugggcccuugugaacgaggccgagacgagcgaggaaaaauccagcaucaucaagcucgggguuagagugaacccccugacgguggacgaacugcagaacuucgagaagggaaagucaaucaccaccaacgcggaucggaccgccgggcgcucuaugcggcgcaaccuccagcgguacaagcugcgccgggagaaccugaucgaaguccucaaggaguauaacuucaucacugacgagaugauacuguccgagaacgggaaccgcaccaccuucgagaccuaccggcugcgcgccaaggcugccguggaggagaucagccuugagcaguucgcgcgggugcugcugaugauaaauaagaagcgcggcuacaaauccagccggaaggccaagggcgccgagaacggcacgcucauugacgggauggaagucgccaagaagauguacgacgaaggcaucacaccaggugagcugugccugcagcuccugaccgcggggaagcgcuacuuccccgauuucuaccguuccgaccugcaggcugaguucgaccgaaucuggaacuuccagaagcaguuuuaccccgacagccucaucgacaagguaaaggaugaggugcggggcaagaacaagucccagacaugggcaauccuggcuaaguacuuugucuggaaagagguggagaacagcuggaacgaagaggaggcccagacgagacggguggaaaaggaauaccgccuggucgggaucaagcggggcgugaagcgcgaggagcucaaguuagagaacuuccaguggcgcgugaaagcacuguccgaacggaugaaccccgaggagcucgcaaucguccuacaggagaucaaugagcagauuagcaacucaagcggguaccugggggccaucuccgaccgcagcaaggagcucuacuucaaccggcagaccgugggccaguaucagauggccgugcuggacaacaauccgaacaucggguugcgcaacauggucuucuaccggcaggacuacuuagacgaguucaacaccaucugggagaagcaggccgaguuccacaaggagcuaacagaggaccugaagaaggagauacgcgacaucgugauuuucuaccagcggcgccucaagagccaaaagggccugaucaacaucugcgaguucgagcggcgccagaucgaggucgagaucgaugggaagaagaaaaucaagacgaucggcucccgggucaucccccguagcagcccccuguuccaggaguucaagaucuggcagacucugaacgacaucgagguguccgugcugggcguaaagaauaagcggaagaaacaggacgacaacuccacuacccugcucgacagcgcggagaauaucgacucucugaagcugaacgucagccgcccccucgacgcggacgaaaagucccugcuggccaaggagcuguucauacgagacaaacuuaccaagucagacgugcuuaagcucuuauucaacaacccgcaaaaccugaaccuaaacuucaaaaacauagacggcaacagaacaggcagugccuuguaucaggcuuucucgaagauccucgagaucuccggacacgagagcauuaacuucaagaaauccgcggacgagaucguggagcaggucaagaccaucuucagcgcccucggcuggaacaccgaggugcucugcuucgacucagagaaggaguuagacaagcagcccuacuucaagcuguggcaucuacuuuacagcuucgaaggggacuccacgcccaccggcgacgggaaucucauccagaagaucgccgaucucugcggcuucgagaaggauuacgccagcauccuggccaacaucaccuuucaggaggacuacggcucccuguccaccaaggcgauccggaaaauccucccccaucugaaggacgggaaccaguacgacgucgccugcgaguaugcgggauacaagcauagcaaauccagccugaagaaggaggaaaucaagaacaaggugcugaaggacaagcuggagcugcucccaaagaacucccugcgcaacccugucguggagaagauccugaaccagauggugaacgucaucaacgccaucaucacgaccuaugggaagccagacgaaauccggaucgagcucgcacgcgagcugaagaagaacgccaaggagcgcgaggaacugaccaagagcaucguagacaccacgaagacccacgagggaauccgggccauccuccagaacgacuucgggaugucccacgugucucgcaacgccaucauccgauacaagcuguacgaggagcugaaggacaacggguauaagacacucuacuccaacaccuacaucccuaaggagaagcuguucagcaaggauuucgacaucgagcacauuaucccgcaggccagguuguucgacgacuccuucagcaacaagacauuggaggucaaguccaucaacauugagaagggcagcaagaccgcguacgacuucguggaggagaaauacggggagcagggccugcaggaguaccucaaccggugcgagguucucuuccgcgacaaaaagaccaagcugcgaaagcugaaaaugcaggagagugagauccccgagggguucaucgaucgagaccuccggaacacccaguacaucgccaagaaggcccugagcaugcugaacgagaucugucgccgggugguggcuaccacgggcgccaucaccgaugagcuccgcgaggacuggcagcugguggacguaaugaaggagcugaacugggagaaguacaaggugcugggccugguggaguacuucgaggacaacgacggacggcugaucggccgcaucaaggacuggaccaaacgcaacgaucaccgccaccacgcgauggacgcccuuaccgucgccuuuacgaaggacguguucauccaguacuucaacaacaagaaugccucccugaagccggacaccaacgaggccgcgauucgcaacaaguacuuccagaacgggaaggccauaccacccaugagccuggacgaguuccgcgcggaggcgaagaagcaccucaacgacacccugaucagcaucaagaccaagaauaagguggucacgaucaaccugaaccggacuaagaaaaagaacggcauaaacaagaaacagcagcagacgccacgcgggcagcuccaccuggagaccguguauggcucccacaagcaguacguagucaaggaggagaaagugaaugcgagcuucgacgccgcgaagaucgcuacggugaacaagccugccuacagggacgcgcugcuccgccgccugcaagagaacggcaacgacucuaagaaggccuucaccggcaagaacagccuggacaagcagccggucuggcucgacgccaagcagaacgagugcgucccggagaaggugaagaccgucaugcuagagaccguguacacggugcggaagcccaucgacgagaaacuuaacgucgacaagguaguggacgcgcgaauccggaaguuacugcaggaccgcaucaaggaguacggcaacgccaaguccgcguucgccaaccuggacgagaaucccauauggcucaacaaggagaaggggaucaccaucaagcgggucagcgugucagggaucagcaaggcccagucccugcacgaaaagaaggacaaggaugggaacuucauccuggacaaggacucccgccggauccccguggacuucgucaacaccggcaacaaccaccacgucgccaucuacaggaagcccgugcucgacaagaagggccaggccguguucgacgagaacggggagcugaaguucgagcuggaggaagugguggucuccuuuuucgacgcaguuacgcgggugaaccucucccagcccaucaucgacaaggacuacaagcgauccgagggauggaaguuccuguucagcaugaagcagaacgaguacuuugucuuccccaacgagaagacgggguucgacccgaaagagaucgaccuguuaaaccccgagaacuacgccuugaucucccccaaccuguuccgggugcagaagaucgccagcaaggacuacgucuuccgccaccaccucgagaccgugguggcggacaggaaggagcugcaagagaucaccuggaaacgcauauccagccuguccauuuuaaaccguaucaucaagguccgcgugaaccacaucggacagaucgugaugaucggggaguacuga

SEQ ID NO: 7980 - RNA, 4284 nt, Artificial Sequence
  Cas9 variant
auggccaagcccaaggacuacaccauagggcuggacauagggaccaacagcgugggcugggucgugacggacgaccagaacaacauccuccgcaucaaggggaaaaaggccaucggagcgcggcuguucgccgaggggaagguggcugccgagcgccgguccuuccgcaccacccggcgccggcugagccgcagacgcuggcggaucaagcuccuggaggaacucuucgacaaggagaucgccaaggucgacccguccuucuucgcgcgccuccaugagagcuggaucucccccaaggacaagaggaagcgcuacagcgccaucguguuccccucccccgaggaggacaagaaguuccacgaguccuacccgaccaucuaccacuuacgagacaagcugaugaaggacgaccaaaagcacgacauacgcgagaucuacaucgccgugcaccagaugaucaaggcgcggggcaauuuccuccaugacgaguccgucgagacauaucgcucaggcauguccagccucgggggccgguccgagcgcaccauccugagcgugcagacacuggaggagcugaacgacuuguucgcugagaacgaggggaccgaggaggccaagcucaacguggccucagccgagcagaucaacgacauccugaccggugggcaccugaacgccgauagccagaaggagaucggcaaccuccugcugccauccagcuuccccuccuucgacgacaaggcgaaggaaaagcaggucaagaagcucaucaagaacguggccaccaacaucagcaaggccuggcuaggcuacaaggccgacuucagcaccauccugaaccucgccaacguggauaaggaccaaaagaaaaucuuugccuuugcccugcagggcggggacgaggaggacaaaguccaggagcuggagucccuccuggagcagagccagaccgacaucguggaccggcugaucgagauccgacacgcgaucgugcucagugagaucguccccguggggaugacgcugagcgaagccaugaucgacaaauacgaccaacauaaggaggaccuuaucacccucaaggccgugauccgcaauaccaaggacaagaagaaggcggccaagcugcaagccaucuacgaccuguacgucaauaaccggcacgccgaucucgcgaaggcgaugaaauugaccggcaucaagaagcgcuccgaacugcucgacccggaagaacugaagaaggccaucagcuccuuacucgacgacucacccgaggccguggagaucaagcagaugcuagaggagaagacguuccugccccuccagcgguccaauaacaacggcgugauccccaaccagcugcaccaggucgagcuagacgagaucauaaagaagcagagcaaguacuacccguuccucgccgagaagaaccccgacgaguccgaggaagcgcagaagaaggcccccaccaagcuggaugcccuguuaaccuuccgcgugccuuacuacguggggccgaugaucaccaaagaggagcaggaggcccaggacggccacagcuucgccuggaugguacggcgcgacccccaggaccaugaggcgaucacgcccuggaacuucgagaagaagguggacaaaauggccagugccacgcaauucaucaagcggaugaccaccaaggacacguaccuccugggggaggacguccugcccgccagcucccucaaguaccagcuguucaccguacugaacgagcucaauaaccugcgaguaaacggcaagaagcugaccucggacgagaaggaacaggucaucgaggggcuguucaagaagcagaagaccgucaaggccgacaaguucgugaaguacuggcaggcgaagcacaucggcgccgacaucaaggucaagggucuguccgacccgaguaaguucaauuccacgaugagcaccuacauugauuucaagaagaucuucggggaucagcugaacgaugugaauagacagaacgacuucgagaagaucaucgaguacagcaccaucuucgaggaccgcaagauccucgaggacaagcugcgggccgacuucgccugguuguccgaggagcagaucaagcaguugugccgccugcggcugcaaggcugggggagacucagcgacaagcugcugacccggcucacggacgccgacggccagaauguauuagaacgccuguggaacuccaaugacaacuucgugcagaucgugagcgaucccaacaucaaagcgaagaucgaacaggagaaucagaagcuccugcgggaugggcaguccgacgacgcaguggagagcauccuggacgacgcguacaccagcccccagaacaaaaaggccauccgccaggucaugcggguggugcacgacaucgucaaagcgugcgacggaaacgugcccgccaaguucgccauugaguucgcccgcagccaagaagacgacccgaagcgcaccaccgcccgggugaaccagaugcagaaaaucuacgaucaaauuuccgacgaagucgugagccagggcgugaaggagcagcuuagcgggaugaagucccugaaggaccgcuacuaccuguacuucaugcagggcgggcgggacgcuuacacgggcgccaagcucaacauagaccgacuguccgacuacgacaucgaccauaucaugccccagaguuuugucaaggacgauucccuggacaaccgugugcucguggcccgcgccgucaauaaucagaaguccgacaaagugcccgccuugcuguucgggaacaagguggucgcagaccucggcaucacggugcgggagaugugggacaaguggcagaagcuggggaugaucagcaagcgcaagcucagcaaucuccugaccgaccccgacgcccugaccgaguaccgggcccagggguucauccgccggcagcucguggagaccagucaggucauaaagcugacggccacgauccugcaguccgaguucccggauucuaagaucaucgaggugcccgccaaauacaacuccaucgugcgcaagcaguucgaccucuacaaaagccgggaggucaacgacuaccaccacgcgaucgacgccuacuuauccaccauugugggcaacuaccuguaccagguguacccuaaccuccgccggauguucgucuacggagaguucaagaaguucagcuccaacgccgaggaaagcgccuacgacguugugagacgggucaagucgaugaauuuccuugacgaccugcuucgcgggacccacggcgacaacaucuacugcaggagcacgggggagaucguguuuaaccgcaaugacauaaucuccaaguugaagcaggcuuacagcuucaagcagaugcuggugacccaggaggucuucaccaaaaaguccgcccucuuugaccagaccguguacccgucucccgagcgggauuccaagaagcguagcggucugaucccgcgcaagaaggggauggacacggaaauuuacggcggguacuccggcaacaaggaugccuacuucgugcuggccgaggccguaaaggagaagggccacacccuccaaaucgugggggugcccauccgggcgcugaacacccugaagaacagcgccaacuacuccgaaaaauuacuggagauaaucaaaccccaagucauguucaauaaggacaccggcaagcccaucaaagggauuaaagacguuaagauccugauggacaagauccccugcagacagcccgugcucgagggcgagagcuacuacaugcuggcuagcucgaaguaccgcuauagccugaagcaaaucucacuaagccagaugucaaugaaguacauccuggacuacaucgacgacccgaacuucaacaagcaugagaugaucaacaucgaccaacaagacgagaaggagugcuuacucagcgucuacgacgagauccuggagaagauggauaaguacuuaccacucuucgacauccgcuccuuccggaagaagcugcacgacgggcgugacgccuucaucgcccuacccgucgcgucggaagagaagaagcccgguaaggucgacgugauccggaaggugcucaagggccugcacgccaacgcagacauaaccaaccuagcugagcucggguucggcacggcagcuuugggggccuuagucuccaccggugggaucaagaucagugacgacgccgucuucaucuaccaguccccgaccggguuauucgagcgccgggugaaggucagcgaccuacugaaguga

SEQ ID NO: 7981 - RNA, 4287 nt, Artificial Sequence
  Cas9 variant
augaagaaaauacugggccucgaccuggggaccacuagcaucggcuccgccuacgugcuggaggccgagaaauccgcggagcagacgaaaaucgucuacuuggggacccgcauuauccuguccagcgccgacgcggagaacuucuccaagggccugagcugcucaccaaccaccgaccggacuuucaagcgcagcaugcggcgccggcuccagcgcuacaagcagcggcgcucaucgcugauccagcaguucaagaagaucgggaucaucaccaacaccgagcagaucauccgggagccgaucuccgagacccacgaacugcuccgcauccggagcaaagccguuuccgagcgggugucgcuggaggaguucgcccggauccugcuuacgaucaauaagcgccggggcuacaaguccaaccgcaagaccagcaaguccaccgaggaggacggcaagcuggucgacgcuauggccgugaccaaggagcugaucaagcucaagaagacgcccgggcaguacauguucgagcgguucaagcgcggcaaguacgccgagaucgacuucuaccccuucgaccugaucaacgagcugaagcaaauuugggagguacaggggcagaaguaccccgauguccucaccgaggaccugcucagcucccuccugaagcagaagaccggcaaggccaaggagcugaucuacucgaaguccgaccucaauccggcggaggugccgaucgacuaccagaaggggaaaaagcugcggaagaccauccugaacaaguacuucgccuacgagucccgaagccucgccgccacgaacaucauccccguggaacaaguuaucaccgccaucguggcgaucugcaagcagaucaauaacuccagcggcuaccuaggcgcaaucggggaccggucccgcgugcuguaugccaauaaccagaccaucggccaguaccucuacgagcgcaucaaggccaacccccaugaccggauccgcggggaggucuucuaccggcaagacuaccuggacgaguucgaccgcaucugggagugccagcagaauuacuacccggccauccugaccaacgaccggaagcaguucauccgcaaccggaucaucuucuaccagcgcccgcucaagagcaaaaaguccgagcuggcauucugugaguucgagagccgggagguggagcauaacggcaaaaaguauacggagggccugcacguggcccccaaguccagccccgucuuccaacacuuccgccucuggcagcggcuggggcagaucgagguguccccgcugcgcaaguggaacaagcagagcaacgagcuguucgagcagcagaacgacaccgaucaggagcggauccugaacaccgaggcuaagcagaagcuguucucauaccucaacuuacuggaccaccucaccgauaacgagauccugaacaucuuaggcuacagccccgacaaguggaagaucaacuuccgcgaaaucaucgggaaccggaccaacaacuccaugaugaaggccuucuucaacaugaaggagaugaccgacggcgagcagaucaacugggaaaagaaccucaccaagauuaccaacgggcagucacugaucucucccgagcagaucguugaccugauccgccaguucuucgagcgggagggcauaacgaccagccugcucuauuucgaccccaccaccgacaacuuccgcgagcagucccacuacagccuguggcaccuccuuuacagcuacgaggacgacaacuccccgacgggcacgaccagccugugcaagacccuggccaagcgguacgggaucccccaugagcucugcccccugcuggcgucccucacguuugagccccaguacggcagucuguccaccaaggccaugaggaagauacugcccuucaugcaggagaacggguacgacaaggccugcgagcucgccggcuaucgccacagcgccuggaccaccaaggaggagaacaccgaacggacgcugaagaacucccugccccuacugcgcaaggggagccuucggaaccccgucguggagaagauccucaaccagaugacccacguaaucaacacccacaucucagaguacggcaaccccgacgaaauccgcaucgagauggcucgggacaugcaggccaacagcaagcagcgcaaggccaugaccacggccaucgcggaggccaccaagcggaacacccaauucaucgaggagauccagaaggaguucggcuucaauccguccaagaacgaccugauaaaguacaagcuguggaaggagcucgcgccccuggggagcaagacccuguauuccaacacguacauccccaaggaggaacuguucaccgccaaguucgagaucgagcacaucaucccccgcgcccuguucuacgacgacagcuucuccaacaagacccuggagcucaacucagucaacaaacugaagggcaacaagaccgcacuggacuacauggauacgcucucccaggagcaggccaacgacuacaucauccggguggaggaacugaagaagaucggggccaucacccaggccaaguacaagaagcuacucauccgcgagaaggaccugggcgacgauuuuacuaaccgggaccugacgaauacgcgcuacaucaucaggcacgccgcggacaugcuccuacaggugaccccgagcaucguccacaccaacgggagcaucaccgccauccugcgccgggacugggagcuccuggacauccugaaggagcucaaccugcccacguaugaguccaucgaccgcaagaucagcgaucccaaggagaagcugaccgaguccguggagcggaaggacggccaggccauuaagaugaucaaggacuggagcaagcgcgacgaccaccggcaccaugccauggacgcccucaucaccgcgcugaccacgcgcaagcacguccaauacuuaaacggcaaccgcggggccgaggagaccgacaaggugcaaaagcuccagcagcugaaggcccugcggaagcagcucaucggcuccgacgggcacuucaucccgcccaugcaugacauccgcgugcaggccaaggaggcgcugucccgggucaucaucuccaccaaggccaagggcaaggugacaacgccgaacaccaacaucaucugcagccgcgacaagacgaccggccggaagaucuacgugaagcagacgacccugacgccccgcggggcccuccacaaggagaugcaguacggcugcaaccacuacuaccuggagaaacagaucccgaucggguccaagcugacagaggaggagauccggcucgucagcucgcccaaaauccgcagcaugcuguccgagcggcuucaggccuacaacaacgaccccaagagcgccuucaccggccgcaacuccauggacaagaagccacucgaggacaagaacaagaaacugguguacaccgacaagaaggugaagcagacuauucuggcgaaccgguucgucaaacgagaccgggucaacagcaagcuggacuuagacaaggugaucgacaccgggaucaagcgcauccuggaacggcgcuuaaagcaguacggcggcaaguacgagaccgccuucuccgaccuggagaacaacccaaucuggcugaacgaggagaaggggauugcaaucaagagcguccggauccgcggcaagaacaacaccaucaccauccggcaaaccaacacgugccgcaucaaguacguggccaacgacaacaaccaccaccucgccguguacgcgcugcccgacgguuccaucgaggacgacaucgucagcuucuucgacgccguggagcggagucgcaagggcuugcccauaaucgacaagcacaagaaccagucccucggguggaaguuuuuauucagcgugaagcaaaacgaguacuuccugcucccccaacagggcgagaagauagacaucgacaccggcgagaucuccaugcagaccacauuuagcccgaaggaccugucccccgaguacaucaugaaccccgacaacuacgccgagcuggcgccccacaucuuccgcguccagagcauauccaagacaccgcaggggaacagggacgugcgcaucuaccucuucaagcagcaguacauaagcggcucccagaaggacagccugcaccugaaggggaucacgcaccggcagaucuccagcgccaaggaccucgccgggcuggugaagauccgggucaaccaccugggucggaucguggccgugggcgagaaguga

SEQ ID NO: 7982 - RNA, 4287 nt, Artificial Sequence; identical to SEQ ID NO: 2182
  Cas9 variant

SEQ ID NO: 7983 - RNA, 4287 nt, Artificial Sequence
  Cas9 variant
augaccaagaaaauacugggccucgaccuggggaccacgagcaucggcugggccuacgugaucgaguccgacaaccccgacgagagcgagaucaagcagaucgggguacgcgugaacccgcugaccaccgacgagcagaccaacuucgagaagggcaagcccuucuccaucaacaaggagcggacguugaagcguggugcccggcgcaaucuggaccgguacaaggaccgccggaacaaccugaucgaggugcucaagaaggcgaacauacugagccaggacuccauccugaccgaggagggccagcacaccacccaccagaccuggcagcuccgcgccaaggccgccgucgacaagaucgagaaggaggaguuagcccgggugcugcucgcgaucaacaagaagcgcgguuacaagagcucccggaaggccaagaacgaggacgaggggcaggccaucgacgggauggccguggcgaagcgccuguacgacgagcagaucacgugcgggcagcuggucuaccagcuucugcgggagggcaagaaguccauccccgacuucuaccgcuccgaccugcaggccgaguucgacaagguguggaacuuccagaagcaguucuaccccaagauucucaccgacgaguucuacaaggagcugaaggggaagggccagcgggccaccagcgcccuguucuacaagaccuacaacuucaacaccgccgagaacaagggcucccgcgaggagaagaagauccaggcguacaaguggcggagcgaggccaucucccagcagcucgagaaggaggagguggccuucguccugaccgagauaaacaacaaccugaacaacagcuccggguaccucggcgccauaagcgaucgcuccaaggaguuauacuucaacaagcagaccguggggcaguaccuguaccagcagcuccaggagaaccggcacgcccgccugaagaaccagguguucuaccggcaggacuaccuggacgaguucgaggcgaucuggaaggagcaggccaagcaccacacggagcucaccgaggagcugaaggccgagauccgcgacaucaucaucuucuaccagcgcaagcucaagagccagaagggccugaucuccuucugcgaguucgagagccgggagauccagaucgacggcaagaagaagaccaucgggcugcgcgucgcccccaagagcagcccccuguuccaagaguucaagaucuggcagaaccucaacaacgugcugguccggaagaagggcagccgaaagcggaacgucaagcaggagauccaggggucccuguucgaggaggagaaggagaucuucguguucgaccucgagaccaaggagaaguuguucgaggagcugaaccucaagggcaaccugagcgcuaacaaggugaucgagcugcucgggcacaagcccacggagugggagaucaacuacuccgcgcuggagggcaaccgcaccaaccaggcccuguacaacgcauaccucaagauccuggacaucgagggcuacgacgaggaccugcugaagcucagcgacaaggacgacaucaacgucgccgaccugaagacccccgccuccgagaucaagaacauggugagggacaucuuccaggugcuggggaucagcaccgacauccucgaguucgacgcggagcuggacggcaaggacuucgagcagcaggccuccuaccagcuguggcaccuccuguacagcuacgagggggacgauucccagagcggcaacgagaagcuguacgagcuccuggagaagaaguucggguucaagaaggagcacucccagguccuggccaacguaacgcucagcgacgacuacggcaaccucuccagcaaggccaugcgcaagaucuacccguucaucaaggagaacaauuacuccaccgcgugcgagcuggccggcuaccggcacagcaagcacucccucaccaaggaggagaucgagaaccgcccccuggacgacaagcuggagcuccuuaagaagaacagccugcggcagcccguggucgagaaaauccucaaccagauggugaaugucgugaacagccugcuggagaagaaccgcaaggagaaccccgacuuccgguucgacgagauccgcaucgaacucgcccgggagcugaagaagaacgccaaggagcgcgccgagaugaccacgaacaucaacuccgcgaagaccgagaacgagaagaucuuuaagcugcuccaggcugaguucgggcuuaagaacccgacccggaacgacaucauccgcuaccggcuguacgaggagcucaagaacaacggcuacaaggaccuguacacgaacaaguacauuccccgcgagauccuguucagcaagcaggucgacaucgagcacaucaucccccagucccgccucuucgacgacagcuucuccaacaagacgaucguguaccgcgagaccaaccuggacaagggcaaccagaccgccuucgacuacaucgacagcaaguacggcaacgagaagguggaggaguacauccugcgcaucgaggcccuccacgacgccuggaagaagaacaaggaggaaggaaucuccaaggcgaaguaccagaagcugcugaagaaggagaccgagaucggcgacggcuucaucgagcgagaccuccgcgagagccaguacaucgccaagaaggccaaggagaugcuguucaagaucacccgguccguggucucaaccuccggguccauuaccgacaagcugcgcgaggacuggggccucaucaacaucaugaaagagcugaacuugcccaaguaccggucccucggguuaaccgagaugcaggagcgcaaguucggccagaaaguggaggugaucaacgacuggaccaagcggaacgaccaccgccaccacgccauggacgcccucacggucgcguucaccaagcacaaccacauccaguaccucaacuaccugaaugcccggaagaacgagaaccacaagcugcacaacaacaucauagccaucgagaaccucgagaccgagaccaugaucgacaacaacggcuccaagcgccggguguucaaggccccgaugcccaacuuccgccagguggcgaaggagcaccuggagaacguccugaucucccauaaggccaagaacaagguggugacgaagaacaagaacaagaucgccgggaaggucgccgcccaggagacccucaccccgcggggacagcugcacaaggagaccguguacgggaaguaccaguacuacgugaacaaggaagagaagaucggcacgaaguucgacgaggagaccaucaacaagguuagcaauccccaguaccgcaagcugcucuuagagcggcuguccgcgaacgggaaugacccgaagaaggccuucagcggcaagaacgcccucagcaagaaccccaucuaccugaacgagaccaagaccgagacggugcccgagguggucaagcugaccuggcucgaggaggacuacuccauccgcaaggacaucacccccgacaacuucaaggacgagaaauccaucgacaagauccuggacgagggcgugaagcggauccugaagaagcgccugcggaagaacgacaacgacccgaagaaggccuucucggaccuggacaagaaccccaucuggcugaacgaggagaagggcauaagcaucaagcgcgugaccaucuccggcgucaacaacgccgagccccuccacuacaagaaggaccacuucgggaacgauauccuggacgagaagggcgacaagaucccuguggacuucgugagcacggggaacaaccaccacgucgcgguguaccgcgacgagaagggcaaucugcaggagaacaucgugucauucuucgaggccgucauccgagugaaucagggccucccgaucaucgacaaggccuacaaccagcaccugggguggcaguuccuguucaccaugaagcagaacgagauguucguguuccccaacgagaaguccggcuucaacccccaggagaucgaccuccuggacccgagcaacaagaagaagauuagccccaaccuguuccgcguccagaagauguccaaggugaucuacgggaacagccccgugcgggaguacgucuuccgccaccaccucgagaccaacguggacgagaagaaggagcugaaggacauaaccuucaagaacaucaagucccucggcuauuucgaggacaucgugaagguccggaucaaccaccucggggacaucgugagcguaggcgaguacuga

SEQ ID NO: 7984 - RNA, 4293 nt, Artificial Sequence
  Cas9 variant
augaagcacauucugggccucgaccuggggaccaacuccaucggaugggcuguggucaaggaggcccagaaugacaacgaacaguccgagaucguggacgugggggucaggguaaacccacugacuacggacgagaagacgaacuucgagaagggcaagccgaucagcaccaacgcggaccggacccucaagcgcuccgcccggcgcaaccuccaacgguacaaguuacgccggaaggagcucaucgagcugcugaaggagcaccagcucaucucgacggacaccauacugaccgagaacgggaagggcaccacguuccagaccuuggaacuccgcgccaaguccgccaaggagaagaucagccuggaggagcuggcccggguguuccucaccauuaacaagaagcgcggcuacaagaguagccggaaggcgaagaacgaggacgaagggcagcugaucgacggcauggaaaucgccaagcgccuguacgaggaaaaccucacgacagggcaguuaucccugcaacucuugaaagagggcaagaaaucccugcccgacuacuaccgcagcgaucuccaguucgaacuggacaaggucuggaacuuccagaagcaguuccacucagacauccugaccgacgaguucuacgcccagcucaaggguaagggccagcgcgccaccucggcgcuguuccuagccaaguaccagaucuacaccgccgaaaacaaaggaucuagagaggacaagaagcuccaggccuaccaguggcgcgucgacgcucugucgaaggagcugacgcgggagcaacucgcguucgugauaaccgagaucaauaacaaucugaacaacagcuccggguaccugggcgcuaucagcgaucgcuccaaggagcuauacuucaauaacgagaccgucggggaguaccuguggaagcagaucgccgccaacccccacaccagccugaagaaccagguuuucuaccggcaggacuaccuugacgaguuugagcagaucuggaagacccagagcgcuuucuauccagagauccugaccgacgagcugaagaaggagcuccgcgauguggucaucuuuuaccagcggaagcugaagucccagaagucccuggugagcuucugcgaguucgagaacaaggagaucgagaucaagaaggaggacggcaccagcaccaagaaggugaucggccucaagguggcgccgaaguccucuccguuauuccaagaguucaagaucuggcaaaaucugaacaacgugcucauccgcaagaaggggucaaagacgaagaaggucgccaagaaccagcaggccgugcuguuugaagaggagaagaccaucagcgagcuggaccuggaggcaaagcaggcccuauucaacgagcugaaccugaagggcaaccucaaagcggacuacugccuagagauccugggguauucccccaaggagugggagaugaacuauaguguguuagagggcaaccgcaccaacaaggcacuguacgaggccuaccugaagaucaccgaccucgagggguacgacgccaagaaucaccugaaggugaagcugaacaaggacgaggucgagcucgacgaccuuaaggugcccgccuccgagaucaaggacauggugcaggcgaucuucaaggaggccggcauaaacacggauauccugcacuucaacgccgagcucgacggcaaggacuucgagaaucaggccuccuaccagcuguggcaccuccuguacuccuacgagggggacgacagcaaauccggcaacgagcugcuguacaagcuccuggaaaccaaguucgguuucaagaaggaguacgcacagaucuuagccaaugucagccucuccgacgacuacggcagccuguccaccaaggcaaugcgaaaaauccauccguacaucaaggagaacaaguucagcaccgccugcgagcuggccggguaccggcacagcaagcacucccucacgaaggaggagaacgacaacaggguacugaaggacucucuggagguccucaagaaaaauucccugcgccaacccguuguggagaagaucuugaaucagaugaucaaccucgucaacgcgcugcucaagaaauaccggaccgagaaccccaacuucaaguucgacgaaauccgcauugagcucgcccgggaacugaaaaagaacgccgaggagcgcgccaacaugaccgccaacaucaacaaagcgaaaaccgagcacgagaagaucaucaagaucuugaaaaacgaguucggccuccccaaccccacgcggaaugacaucauacgcuaccggcucuacgaggagcugaaggccaacggguacaaggaccucuacaccaacaucaagaucccccaggagaaacuguucacaaaagagaucgacaucgagcacaucauccccaagagcaggguauucgaugacucuuucucuaacaaaacccucuccuucagaaagaccaaccucgacaaaggugagaggacggccuucgacuacauggagagcaaguucggggccgacaagcuggaagaguacguggcucgggucgaggaccuguacaagaacaacaucaucuccaaggcgaaguaccagaagcuccugaagaaggagagcgagaucggcgacggcuucguggaacgcgaucugcgggagacccaguacaucgccaagaaggccaaggagauccuccugcagaucacacccaacguacugucaaccagcgggggcaucacggaccgccucagagaggacugggaucugaucaacgucaugaaggagcugaauuuaccgaaguacagagcucugggucugacccaaauggaggaccgcaaauacgggcaacagguggaagugaucaccgacuggaccaagcggaacgaccaccgccaccacgcaauggacgcccugacgguggcuuucaccaaacauaaucacauacaguaccugaacuaccugaacgcccggaagaaugagaagcauaaggagcacaguaacaucaugggcauccagcagcucgagaccaucaaggugaccgacaagaacggcaacgagaaacgcguguucaaagccccaaugcccaacuuccggcaggucacgaaggcguuccuggaaaacauucugaucagccacaaggccaagaacaagguggugaccaagaacaagaacaaggucgcaggcuccaacaaggugcaggaggugcucacgccccgcggccagcugcacaaagagacugucuacgggaaguaccaguauuacgugcagaaggaagagaagauuggcgccaaguucgacuuagagaccaucaagaaagucgccaacccgcucuaucagagccugcugaagaagcggcucgaggagaacgggggcgaccccaagaaggcuuucaccgggaagaacucccuggccaagaaccccaucuaccuggacgacacccagaccgagcaacuccccgagaaagucaagcugguguggcuggagaacagcuucucaauccgcaaggacaucacuccggagaacuucaaggacgagaaacucaucgacaagauccuggaugagggcgugaagcgaauccugaaggagcggcuccagucauuuggcaacgacgccaagaaggccuucagcgaccuggacaagaaccccaucuggcugaacaaggaaaaggggaucaccauaaaacgugucaccaucuccggcguggccaacgcggagccccuccacaccaagaaggaccaccuggggaaggagauccuggauaaggaggggaagcccaucccgguggauuucaucagcacagguuccaaccaccacguggcgguguaccgcgacgagaaaggcaaccuccaggaaaaaguggucagcguguucgaggccguggugcgggccaaccaggggcugcccaucauagauaaaaccuacaaccagcaccucggcugggaguuccucuuuaccaugaagcagaacgagauguucguguuucccaacgaguccaccgguuucaaccccaacgacaucgaccugcuggaccccaagaacaaacgcaucaucucacccaaccucuuccgggugcagaaguucucuaagcugcaguacggaaacagcuucguccgcgaguucguguuccggcaccaucuagagaccaccguggaggaccguaaggagcugcaggggauaacuuacaagcaaaugaagaacuccaccuucuuuaacgacauuauuaagguccggaucaaccaccucggggacaucguaagcaucggcgaguacuga

SEQ ID NO: 7985 - RNA, 4293 nt, Artificial Sequence
  Cas9 variant
augaagcacauccuaggccuggaccuggggaccaacagcaucggcugggccguggucaaggaggcccagaacgacaacgaacaguccgagaucguggacgucgggguccgcgugaacccccugaccacggacgagaagaccaacuucgagaagggcaagccgaucagcaccaacgcggaccggacucucaagcgcuccgcccggcgcaaccugcagcgguacaagcugcgccggaaggagcucaucgagcugcugaaggagcaccagcucaucagcacggauaccauccugacggagaacgggaagggcaccacguuccagacccuggagcuccgcgccaaguccgccaaggagaagaucagccuggaggagcuggcccggguguuccucaccaucaacaagaagcgcggcuacaaguccagccggaaggcgaagaacgaggacgaggggcagcugaucgacggcauggagaucgccaagcgccuguacgaggaaaaccucaccacggggcagcugucccugcagcuccugaaggagggcaagaagucccugcccgacuacuaccggagcgaucuccaguucgagcuggacaaggucuggaacuuccagaagcaguuccacagccacauccugaccgacgaguucuacgcccagcucaaggggaaaggccagcgcgccaccuccgcgcuguuccuggccaaguaccagaucuacaccgccgagaacaagggcagcagggaggacaagaagcuccaggccuaccaguggcgcgucgacgcccuguccaaggagcugacgcgggagcagcucgcuuucgugaucaccgagaucaacaacaaccugaacaacagcuccggguaccugggcgccaucagcgaccgcaguaaggagcucuacuucaacaacgagaccgucggggaguaccuguggaagcagaucgccgccaacccgcacaccagccugaagaaccaggucuucuaucggcaggacuaccucgacgaguucgagcagauauggaagacccagagcgccuucuaccccgagauccugaccgacgagcugaagaaggagcuccgcgacguggucaucuucuaccagcggaaacugaagucccagaagucccuggugagcuucugcgaguucgagaacaaagagaucgagaucaagaaggaggacggcaccagcaccaagaaggugaucggccucaaggucgcuccgaaguccagcccccuguuccaggaguucaagaucuggcagaaccugaacaacgugcucauccgcaagaagggauccaagacgaaaaagguggacaagaaccagcaggccguccuguucgaggaggagaagaccaucuucgagcuggaccucgaggccaagcaggcccucuucaacgagcugaaccugaagggcaaccucaaggccuacuacugccuggagauccugggguacagccccaaggagugggagaugaacuacuccgugcucgagggcaaccgcaccaacaaggcgcuguacgaggcauaccugaagaucacugaccucgagggguacgacgccaagaaccaccugaaggugaagcugaacaaggaugaggucgagcucgacgaccuuaaggugcccgccagcgagaucaaggacauggugcaggccaucuucaaggaggcgggcaucaacacggacauccugcacuucaacgccgagcucgacggcaaggacuucgaaaaucaggccagcuaccagcuguggcaccuccuguacagcuacgagggggacgacuccaagucuggcaacgagcugcuguacaagcuccuggagaccaaguucggguucaagaaggaguacgcccaaauccuggcgaacgucucccucagcgacgacuacggcucccugagcacgaaggccaugcggaagauccacccguacaucaaggagaacaaguuuuccaccgccugcgagcucgccggguaccgccacagcaagcauagccucacgaaggaggagaacgacaaccgggugcugaaggacucccuggaaguccucaagaagaacagcuuacgccagcccgucguggagaagauccugaaccagaugaucaaccucgucaacgcccugcugaagaaguaccggaccgagaaccccaacuuuaaguucgacgagauccgcaucgagcucgcacgggagcugaagaagaacgccgaggagcgcgcgaacaugaccgugaacaucaacaaggccaagaccgagcacgagaagaucaucaagauccugaagaacgaguucggccuccccaacccgacgcguaacgacaucauccgcuaccggcuguacgaggagcugaaggccaacggcuacaaggaccucuacaccaaugaguacaucgagaagcaggaccuuuucaccaagaacaucgacaucgagcacaucauccccaagucccgcguguucgacgacagcuucuccaacaagacccugagcuuccggaagaccaaccucgacaagggggagcgcacggcguucgacuacaucgaguccaaguucggggccgacaagcuggaggaguacgucgcccggguggaggaccuuuacaagaacaacaucaucagcaaggccaaguaccagaagcuacugaagaaggaguccgagaucggggacggcuucguggagcgcgaccugcgggagacccaguacaucgccaagaaggcuaaggagauccuccugcagaucacccccaacguccugucgaccuccgggggcauaacggaccgacuccgggaggacugggaccugaucaacgugaugaaggagcugaaccugcccaaguaccgcgcccugggccugacgcagauggaggaccgcaaguacgggcagcaggucgaggugaucaucgacuggaccaagcggaacgaccaccgccaccacgccauggacgcccucaccguggcguucacgaagcacaaccacauccaguaccugaacuaccugaacgcccggaagaacgagaagcaccgcgagcacagcaacaucaugggcauccagcagcucgagaccaucaaggugacagacaagaacgggaacgaaaagcgggucuucaaggcuccgaugcccaacuuccgccaggugaccaaggcguuucuugagaacgugcugaucucccacaaggccaagaacaaggucgugacgaagaacaagaacaaggucgcgggcagcaacaagguccaggaggugcucacgccccggggccagcugcacaaggagaccguguacgggaaguaccaguacuacguccagaaagaggagaagaucggcgggaaguucgaccuggagaccaucaagaagguggccaacccccucuaccagucccuguugaagaagcgccucgaggagaacggcggggacccgaagaaggccuucaccggcaagaacagcuuggccaagaaccccaucuaccuggacgacgcccagaccgagcagcuccccgagaaggugaagcuggucuggcuggagaacuccuucagcauccggaaggacaucacccccgagaacuucaaggacgagaagcucaucgacaagauccuggacgagggcgugaagaggauccugaaggagaggcuccagagcuucgggaacgacgcgaagaaggccuucuccgaccuggacaagaacccgaucuggcugaacaaggagaagggcaucgccaucaagcgcguagccaucagcggggucgccaacgcggagccccuccacaccaagaaggaccaccugggcaaggagauccuggacaaggaggggaaguccauccccguggacuucaucagcacgggcaacaaccaccacguggccgucuaccgcgacgagaagggcaaccuccaagagaaggugguguccgucuucgaggccguggugcgcgccaaccaggggcuccccaucaucgacaagaccuacaaccagcaccucggcugggaguuccucuucaccaugaagcagaacgagauguucgucuucagcaacgaguccaccggguucaacccgaacgacaucgaccugcucgaccccaagaacaagaagaucaucagccccaaccucuuccgggugcagaaguucuccaagcugcaguacggcaacagcuucgugcgcgaguucgucuuccggcaccacuuggagacgaccguggaggaccgcaaggaacugcaggggaucaccuacaagcagaugaagaacuccgcguucuucaacgacaucaucaaggugcggaucaaccaccucggcggcaucgucagcgugggggaguacuga

SEQ ID NO: 7986 - RNA, 4293 nt, Artificial Sequence; identical to SEQ ID NO: 2186
  Cas9 variant

SEQ ID NO: 7987 - RNA, 4293 nt, Artificial Sequence
  Cas9 variant
augaagcacauccugggccucgaccuggggaccaacagcaucggcugggccuacgugaaggaggccgagaacgacaccgagacauccgaaaucgucgaccugggggugcgcgugaauccccucaccaccgacgagaagaccaacuucgagaagggcaagccgaucagcacgaacgcggaucggacccugaagcgcuccgccagacgcaaccugcagcgguacaagcuccgccggaaggagcugaucgagcugcucaaggagcaccagcugaucucugaaaacaccauccugaccgagaacgggaagggcacgaccuuccagacccucgagcugcgcgccaaguccgccaaggagaagaucagccugggcgagcucgcccgggucuuccugaccauuaacaagaagcgcggguacaaguccagccggaaggcgaagaacgaggacgagggccagcugaucgacgggauggaaaucgccaagcgccucuacgaggagaaccugacgaccgggcagcugucccuccagcuguuaaaggaggggaagaagucccuccccgacuacuaccgguccgaccugcaguucgaguuagacaagguguggaacuuccagaagcaguuccacagcgacauccucaccgacgaguucuacgcccaacugaagggcaagggccagcgcgccaccuccgcgcuguuccucgccaaguaccagaucuacacggccgagaacaaggggagccgggaggacaagaaacuucaggccuaccaguggaggguugacgcccuguccaaggaauugacccgggagcaguuggcguucgucaucaccgagaucaacaacaaccugaacaacagcuccggcuaccucggggccaucagcgaccgcuccaaggagcuguacuucaacaacgagaccgugggcgaguaccuguggaagcagauugccgccaacccccacacgagccucaagaaccagguguucuaccggcaggacuaccuggacgaguucgagcagaucuggaacacucaggcccaguucuacccccagauccugaccgacgagcucaagaaggagcugcgcgacgucgugaucuucuaccagcggaagcugaagucccagaagucccucgucagcuucugcgaguucgagaacaaggagaucgagaucaagaaggaggacggcaccuccacgaagaaggucaucgggcugaagguggcgcccaagagcagcccccuguuccaggaguucaagaucuggcaaaaccucaacaacgugcugauccgcaagaagggcagcaagaccaagaaggccgccaaaaaccagcaggccguccuguucgaggaggagaagaccaucuccgagcuggaccucgaggccaagcaagcgcuguucaacgagcugaaccucaaggggaaccugaaggccgacuacugccuggagauccucggcuacagccccaaggagugggagaugaacuacuccgugcuggaggggaaccgcaccaauaaggcccuguacgaggccuaccucaagaucacggaccuggagggcuacgacgccaagaaccaccugaaggugaagcucaacaaggacgaggucgagcuggacgaccugaagguucccgcgagugagaucaaggagauggugcaggccaucuuuaaggaggccggcaucaacaccgacauccuccacuucaacgcugagcuggacgggaaggacuuugagaaccaggcauccuaccagcuguggcaccuccuguacagcuaugagggcgacgacucaaagagcgggaacgagcugcucuacaagcugcuggagaccaaguucggcuucaagaaggaguacgcgcagauccucgccaaugucucccugagcgacgacuacgggaaccuguccaccaaagccaugcggaagaucuacccguacaucaaggagaacaaguucagcacggccugcgagcucgcgggcuaccgccacuccaagcacagccugaccaaggaagagaacgacaaccgggugcucaaggacagccucgaggugcugaagaagaacucccugcgccagcccgucguggagaagauccucaaccagaugaucaaccuggucaacgcccugcucaagaaguaccggaccgagaaccccaacuucaaguucgacgagauccgcaucgaacuggcccgggaacugaagaagaacgcugaggagcgcgccaacaugaccgcgaauauuaacaaagccaagacggagcaugagaaaaucaucaagauccucaaaaacgaguucggccugcccaacccaacccggaacgacaucauccgcuaccggcuguacgaggagcucaaggccaacggguacaaagaccuguacaccaacaucaagaucccccaggagaagcuguucaccaaggagaucgacaucgagcacaucauccccaagagccgcguguucgaugacuccuucagcaacaagacccucuccuuccggaagacgaaccuggacaagggcgagcgcaccgccuucgacuacauggagagcaaguucggggccgacaaguuagaggaguacguggcgcgggucgaggaccucuacaagaacaacauaaucuccaaggccaaguaccagaagcugcugaagaaagagagcgagaucggcgacggguucguggagcgcgaccuccgggagacccaguacaucgccaagaaggccaaggagauccugcugcagaucacccgcaacgugcuguccacaagcggcggcaucaccgaccggcugcgcgaggauugggaccuggucaacguuaugaaggagcucaaccugcccaaguaccgcgcgcuggggcucaccgagauggaggaccggaaauauggccagcaggucgaggugaucaucgacuggaccaagcgcaacgaccaccggcaccacgccauggacgcccugacgguggccuucaccaagcacaaccacauccaguaccugaacuaccucaacgcccgcaagaaugagaagcaccgggagcacuccaacaucauggggauccagcagcuggagaccauuaagguaaccgacaagaacggcaacgagaaacgcgucuucaaggcgccgaugcccaacuuccgccaggucacgaaggccuuccuggagaacgugcucaucagccacaaggccaagaacaaggucgugaccaagaacaagaacaagguggccggcuccaacaagguccaggaggugcugaccccgcgggggcagcugcacaaggagaccguguacggcaaguaccaguacuacguccagaaggaggagaagaucggcgggaaguucgaccucgagacgaucaagaaggucgccaacccccuuuaccagagccugcuuaagaagcggcuggaggagaauggcggggacccgaagaaggcguucacugggaagaacucccuggcgaagaaccccaucuaccucgacgacgcacagaccgagcagcugcccgagaaggugaagcuggucuggcucgagaacagcuucuccauccgcaaggacauuacccccgagaacuucaaggacgagaagcugaucgacaagauccuggacgagggggugaagcggauccucaaggagcgccugcagagcuucggcaacgacgccaagaaggccuuuagcgaccuggacaagaacccgaucuggcucaacaaggagaaggggaucaccaucaagcgggugaccaucuccggcgucgcgaacgccgagcccuuacacaccaagaaggaccaccuggggaaagagauccucgacaaggagggcaagcccauccccguggacuucaucucuaccggcuccaaccaccacguggccgucuaccgcgacgagaaggggaaccugcaggagaagguggugagcgucuucgaagcuguggugcgggcgaaccaaggccugccgauaaucgacaagacguacaacgagcaccucgggugggaauuucuguucaccaugaagcaaaacgagauguuugucuuccccaacgaguccacgggcuuuaaccccaacgacaucgaccugcuugacccgaagaacaagcgcaucaucagccccaaucuguuccgggugcagaccaucuccguggucaaguacgggaacgccaucgugcgcgacuucaaguuccggcaccaccuggagacgaccguggaggacaagaaggagcugcagggcaagacguaccagcagaucaagagccucagcccccugaacgacaucaucaaaguccgcaucaaccaccugggcgacaucgugagcgugggggaguacuga

SEQ ID NO: 7988 - RNA, 4293 nt, Artificial Sequence
  Cas9 variant
auggcgcagaaguacauucugggccucgaccuggggaccaacagcaucggcugggccguagucaaggaggccgagaacgacaacgagcaguccgagaucguggacguggggguccgcguaaacccccugaccacggacgagaagaccaacuucgagaagggcaagccgaucagcaccaacgccgaccggacccucaagcgcggggcccggagaaaccuccagcgguacaagcugagacggaaggagcucauuaagauccugaaggagcaccaguugaucuccgacgauacgauccuggccgagaacggcaagggcaccaccuaccagaccuugaagcugagagccaagagcucuaaggagaagaucagccucgaggagcuggcgcgcguguuccugacgauuaacaagaagcgcggguacaaguccagccggaagaccaagaacgaggacgagggccagcucaucgacgggauggagaucgccaagcgccuguacgaggagaaccugaccaccggccagcucucccugcagcugcucaaggaagggaagaagucccugcccgacuacuaccggagcgaccuggagcuagagcuggacaaggucuggaacuuccagaagcaauuccacagcgacauccugacggacgaguucuacacccaacuaaaaggcaagggccagagggccaccuccgcccuguuccuggagaaguaccagaucuacaccguggagaacaaagguaaucgggaggagaagaaccuccaggcguaccaguggcgcguggacgcccugagcaaggagcugacgcgggaggagcucgccuucgucaucacggagaucaacaacaaccugaauaacuccucaggcuaccugggggccaucagugaccgcagcaaggagcucuacuuuaacaacgagaccgugggcgaguaccuguggaagcagaucgccgcgaacccgcacaccucccugaagaaccagguguucuaccggcaggacuaccucgacgaguucgagcgcaucuggaacacgcaggcucaguucuacccccagauccugaccgagagccuuaaaaaggagcuccgggacguagugaucuucuaccagcgcaagcugaaaagccagaagucccuggugagcuucugcgaguucgagaacaaggagaucgagaucaaaaaugaggacggcaccaccacgaagaaggucaucgggcucaagguggccccgaaauccagcccccuguuccaggaguucaagaucuggcagaaccugaacaacguucucauccgcaagaaggguuccaagaccgagaaggucgccaagaaucaacaggucgugcuguucgaggaggagaagaccaucagcgagcuggaccuggaggccaagcaggcgcuauucaacgagcugaaccugaagggaaaccucaaagcagacuacugccuggagauccuggguuauuccagcaaggagugggagaugaacuacuccgugcucgaagggaaccggaccaacaaggcccuguaugaggccuaccugaagauuacggaccucgagggauacgacgccaagaauuaccugaaggucaagaguaacaaggacgagguggagcuggacgaccucaaggugccagcguccgagaucaaggagauggugcaggccauauucaaggaggccggaaucaacaccgacauccuacacuuugacgccgagcuggacgggaaggacuuugagaaccagggcagcuacaagcucuggcaccuccuguacuccuacgagggggacgacagcaaguccggcaacgaacugcuguacaagcugcucgagaccaaauuugggcugaagaaggaguacgcccagauccuugcgaacaucagccucagcgacgacuauggcaaccuguccaccaaggccaugcgcaagauccaccccuauauuaaggagaacaaguucuccacggccugcgagcuggccggcuaccggcauagcaagcacagcuuaaccaaggaggagaacgagaaacgcguccugaaggacgggcuggagguccucaagaagaacucccugcggcagccgguggucgagaagauccugaaccagaugauuaaccucgugaacgcgcugcugaagaaguaccgcaccgagaaccccaacuuuaaguucgacgagauccggaucgaacuggcacgcgagcugaagaaaaaugccgaggaacgggccaacaugaccgcgaacaucaacaaggcgaagacggagcacgagaagaucgacaagaucuugaaaagcgaguucggccugcccaaccccacacgcaacgacaucauacgguaccgcuuauacgaggagcugaaggccaacggguacaaggaccucuacaccaaccgguauaucuccagcgaaaagcuguucuccaaagagaucgacaucgagcacaucauccccaagucucgcguguucgacgacuccuucagcaauaaaaccaucguauaucggaccgacaaccuggauaagggcgagcagacggccuacgacuacaucgaguccaaguucggggccgagaagcugaaggaguacaugacccgcgugaaggaccuguaccagaagaagaucaucagcaaggccaaguaccagaagcugcucaagaaagagucagagaucggcgauggcuucguggagcgggaucugcgcgagacccaguacaucgcgaagaaggccaaggaaauccugcuccagaucacccacaacguccugagcacauccgggggcaucaccgaccgacugcgcaaggacugggggcucgugaacgugaugaaggaacugaaccugccgaaguaccgcgcccucgggcugaccaagauggaggaccggaaauacggccagcaggucgaggugaucaccgacuggacgaagcgcaacgaccugcggcaccacgccauggacgccuugaccguggcguucaccaaacauaaccacauccaguaccugaauuaucugaacgcccgcaagaacgagaagcauaaggagcacaacaacaucauggccauacagcagcucgagaccaucaaggucaccgacgagaacgggaacgagaagcggaucuuuaaggccccuaugcccaacuuccgccagguggcaaagaccuuccuggagaacguccugaucagccacaaggccaagaacaaggucgugaccaagaacaagaacaagaucuccggcucuaacaaggugcaggagguccucacgccccgggggcagcugcacaaggagaccguuuacggcaaguaccaguacuacgugcagaaggaggagaagaucggcgccaaauucgacuccgagaccaucgagaaggucgccaauccccuguaccagucacuccugaagaagcgccuugaggagaacggcggcgaccccaagaaggccuucaccggcaagaacucauuagcgaagaaccccaucuaccuggacgacacccagacagagcagcugccggagaaggugaagcucguguggcucgagaacuccuucuccauccggaaggacaucacccccgagaacuucaaggacgagaagcugaucgacaagauccucgacgagggcgucaagcgcauccugaaggagcggcugcaguccuucgggaacgacgccaagaaggcguucuccgaccucgagaaaaauccuaucuggcugaacaaggagaagggcaucgccaucaagcgcgugaccaucuccggaguggccaacgcggagccccugcacaccaagaaggaccaucucggcaaggagauccuagacaaggaaggcaagccgauccccgucgacuuuaucagcacggggaacaaccaccacguggccguguaccgggacgagaagggcaaccugcaggagaagguccucuccguguucgaagccgugguccgggccaaccagggguuacccaucaucgagaaaaccuacaaucagcaccugggaugggaguuccucuucagcaugaagcagaacgaaauguucguguuccccaacgagucuaccggguucaacccgaacgacaucgaccugcuggaccccaaaaauaagcggauuaucagccccaaccucuucaaggugcagaagcuggccaccaagaacuacauguucacucaccaccucgagacuaaguccaucgacggggacaugcugaagaacaaaaaggagcucucaggcauccuguacaauuuuauccagacaccgcagaagcuguaugggauaaucaagguccgcauuaaccaccucggcgacaucguuuccgugggggaguacuga

SEQ ID NO: 7989 - RNA, 4296 nt, Artificial Sequence
  Cas9 variant
augaagcgcauucugggccucgaccuagggagcuccaguaucggcugggcccuggugaacgaggccgaguccaagaacgagcggagcuccaucgugaagcucggggugcgcgugaacccccugacggucgacgagagcauaaacuucgagaagggcaaguccaucacuacgaacgcggaccggacccugaagcgcagcaugaggcgcaaccuccaccgguacaagcugcgccgggaggcccugaucgaggugcucaaggagugcaaguucaucacugaggacaccauccuguccgagaacgggaaccgcacgaccuucgagaccuaccggcugcgcgugaaggcccucaccgaggagaucagccuggaggaguucgcucgggucuuaauaaugaucaacaagaagcgcggcuauaaguccagccggaaggccggcggggcggaggaggacacgcucaucgauggcauggacaucgcccgcaaacuguacgacgccaaccugaccccgggggagcucugccugcagcugcucuccgccggcaagaaggugcugccggacuucuaccggagcgaccugcagaaugagcucgaccgcaucugggagaagcagaaggaguacuaccccgggauccugaccgcggcccugaaggaggagcuccggggcaagaagcgcgacgccgugugggccaucugcgccaacgcguucgucuggaaggagacauacacggaguggaauaacgaggaguccaagaacgagcagaucgagaaggagcacaagcuggagggcaucuacuccaagcggaagcgcgacgaggccaagaaggagaaccugcaguggcguguguccgggcucaaggagaaacugagccuggagcagcucgugaucauccugcaggagaucaacacccagaucaacaacuccagcggcuaccuggggaccauuagcgacagguccaaggagcucuacuucaacaagcagaccgucggccaguaccugauggacauccuggacaacaaccccaacgccagccuccgcaacaucguguucuaccggcaggacuaccuggacgaguucaacgugcugugggagaagcaggccgaguuccacaaggagcucacgggcgagcugaagaaggagauccgagacaucaucaucuucuaccaacggagacugaagucccagaaggggcucaucagcuucugcgaguucgagucccggcagaucgagguaaagauagauggcaagcgcaagauccggaccguggggaaccgcgugaucccgcggagcagcccccuguuccaggaguucaagaucuggcagauccugaacaacauagaagucaccgcaguagguaauaagaacaagcagcgcaugcagaacggguccaacgagcccgacgacaccgagcagcucgagcugaacggccggcgcuaccuguaccaggaggagaaggagcugcucgcgaaagagcuguucgugcgggacaagaugacgaagcuggacguccuccgccugcuguucgacaaccccgaggagcucgaccugaacuucaagaccaucgacggcaacaagaccggguaccuguucuuccaggccuacuccaagaugaucgagaugagcggccacgagccgguggauuucaagaagcccaucgagaagaucguggagcaggucaaguccguguucguccucuuaaacuggaacaccgacauccugagcuucgacuccaacaaggaacucgacaagcagagcuacuacaagcuguggcaccuccucuacucauucgagggggacaacacgcccaccgguaacgguugccuggugcagaagaucauggacucuuacggccugggcaaggaguucgccaagauccucgcaaacaucaccuuccaggaggacuacgggucccugagcgccaaggcgauccacaagauccugccccaccucaaggagggcaaccaguacgacguggccugcgaguacgccggguacagacacuccaagagcagccugaccaaggaggagaucgccaacaagguccugaaggacaagcucgagguucugccccgcaacucccugcggaaccccgugguagagaagauccucaaccagauggugaacgugaucaacgccaucaucgaggcguacggccgccccgacgagauccgcgucgagcuggcccgggagcugaagaagaacgccaaggagcgcgagaagcucaccaagagcaucgccgagaccaccaagacccacgaggcgcacaagaagcugcuacaggaggaguucgggcucaagaacgugggccgguccgacauccugcgcuacaagcuguacaaagagcucgagagccggggcuacaagacgcuguacuccaacaccuacaucccccgcgagaagcuguucagcaaggaguucgacaucgaacacaucaucccgcaggcccggcuguucgacgacuccuuuagcaacaagacccuggaggccaggaacguuaacaucgagaaggggaaccggaccgccuacgacuucgugaaggagaaguucggcgaguccgggacggacaauagccuggacugcuaccucaacaacaucgaggugcuguucguguccggcaagaucagcaagaccaaguacaccaagcucaagaugaccgagcaggacauccccggcggguucaucgagcgcgaccuccggaacacccaguacaucgccaagaaggcgcuguccaugcugaacgagaucagccgcugcgucguggccacguccggcagcaucaccgacaagcuccgggaggacuggcagcugguggacgucaugaaggagcugaacugggagaaguacaaggcccucgggcugguggaguacuucgaggacaaggacggcaagcagaucgggcgcauuaaggacugguccaaacggaacgaccaccgccaccacgcuauggacgcccugaccguggcguucaccaaggaggucuucauccaguacuucaacaacaaaaaugccagccucaaccccaacacgaacgaguacgccaucaagaacaaguauuuccagaacggccgggccaucgcccccaucccgcugaacgaguuccgcgcggaagccaagaagcaccuggagaacacccuaaucaguaucaaggccaagaacaaggugauuaccaacaacaucaacaagaccaagaagagaggcggggugaauacgaagaagcagcagacgccccgcggccagcugcaccuggagaccaucuacgguugcugccggcaguaccucaccaaggaggagaaggucaacgccuccuucgacgugagcaagaucgcgacgguguccagcuccgucuaccgcgacgcccugcuaaagcgccuccaggagcaccacaacgaccccaagaaggccuucgccggccggaacagccuggacaagaagcccguguggcuggacaaggagcagauccgcaaggugccggagaaggucaagaccgugaccuucgagaccaucuacacgauccggaaggagaucucccccgaccuccgcguggacaagaucaucgacagcgggguccggaagaugcugaccggccgccugaaggaguacggcaacgacgccaagaaggcguucuccaaccucgacgagaagcccaucuggcugaacaaggagaaggggauccccaucaagcgggugaccaucagcggcaucuccaacgcccagagccugcacgugaagaaggacaaggacgggaagccgguccucgacggcaacgggcgcaacauacccguggacuucguuaacacaggcaacaaccaccacgucgccguguaccggcgccccgugaucgacaagaacggccagauggucaucgacgagaacggaaaccugaaguacgagcuagaggaggugguggucaccuucuucgacgccgugacccgggugaaccucggccagccgaucaucgauaaggacuacaaggccuccgagggguggcaguuccuguucagcaugaagcagaacgaguacuucgucuuccccaacaagaagaccggcuucaaccccaaggagaucgaccugcucgacgcggacaacuacggguuaaucucccccaaccuguuccgcgugcagaaguucacccacaagaacuacguguuccggcaccaucucgagacaacaaucaaggacaccagcuccauccugcgcggcaucaccuggaucgacuuccggagcucuaagggccuggacagcauagucaaggugcgcgucaaccacaucgggcagaucgugagcgugggcgaguacuga

SEQ ID NO: 7990 - RNA, 4299 nt, Artificial Sequence
  Cas9 variant
augaagaagauccugggcuuagaucugggguccaauucgaucggcugggcccuggugaacgaggcagagaaccgcgacgaggcgagcucuaucaucaaacucgguguccgagugaacccccugaccguggacgagaugcagaacuucgagaagggcaagagcauuaccacgaacgccgacagaaccuuaaaacgcuccaugcgccggaaccuccaacgcuauaagcugcggcgcgacgcccugaucaagcuccugaagaaggugggguucaucgccgacggcacaauccugagcgagcagggcaaccgguccaccuucgagacguaccgccuccgggccaaggcgccugacgaggagauaagccugcaggagcuggcccgggugcuccugaugaucaacaagaagcggggguacaaauccagccgcaagaucaaggagaaggaagccgggacccuuaucgacgggaugaagguggcuaagaagcucuacgaugaggacuuaaccccgggccagcugugccuccagcugcuggaaucagggaagaagucccuccccgacuucuacucaagcgacuuacaagaagaguucgaccggaucuggaauuuccagaagcaguucaaccccaaggcguuuugcgacaccgccaaggaggagauuaagggcaagaacaagucccagacgugggccauccuggccaaguacuucaucuggacggacgagauggucguguggaacgaaaaggaguccaagaccgaacgcguggagaaggagugcaagcucgucggccuuaaacggaccgugaagaaggaggagcagcguaaagagaacuacagguggcgcgugcaggccuuaacagagcagcucgaucuggggaaggucgccguggugcugcaggagaucaacggccagaucuccaccuccucuggguaccucggcgccaucagcgacaggagcaagguacuguauuucaaccgccagaccgugggccaguaccagauggccgagcuagagaagaaccccaacaccucucuccgcaacaugguguucuaccggcaggacuaccuggacgaguucgacaagaucugggagaagcaagccgaguuccacaaggagcugacugucgagcucaagaaggagauccgcgacaucaucauauuuuaccagcggcgccucaaaagccagaaggggcuaaucggauucugcgaguucgagaaucgggagaucaugguggagaagaacgggaaaaugcaagccaagguggucggaugcaaggugaucccacgcucccacccccucuuccaggaguucaaaaucuggcagacccugaacaauguggaggucuucgcgggggagaaaaagugcaagcgaaagcgcacagacgccuuccccggccuguucgacggcaccgaagacacgcucaugguggagggguggcgguaccuguaccaggaggagaaggagauuuuagccaaggagcugagcgucaagaagagucugaagaaggaguacauccugaagcugcuguucgacaacccgcaagaccuggacaugaauuucgagcagaucgagggcaacgacaccgggaacgugcuguucagcgccuacuccaagaugaucgagaaguauggcuacgagccccucgacuuuggcaagucgaccgacgagaucaucgagcgccuccaggugauuuucaccgaccugggguggaacacggaccugcuguucgucgaccugaacaaggagggcaaggaccucgagaagcagcccuauuucaagcuguggcaccuccucuacuccuucgagggggauaacacccccaccggcaacgggaaacuuguggaaaagcugauggagcucugccaugugggcaaggagugcgcccuggagcuugucaacaucagcuuccaaaacgacuacgggagucucucagcgaaagccaucaagaagauccugccguaccugaaggagggcaacagauacgacguugccugcggcuacgccggguaucggcacuccaagagcucccucacgaaggaggagaucgaaaacaagguacugaaggacaaguuagacauccuucccaagaacagccugcgcaaccccgucaucgagaagauacugaaccagaugguaaacgugauaaacgcaaucaucgacacguacggcaagccugacgagauccgagucgagcucgcucgggagcugaagaaguccgccaaggagagagacgagcugaccaaggccaucgccaagagcacccgggagcacgaagaaauccgcaaagugcuccaagaggaguucgggaugaucaacgugucccggaacgacaucauccgcuacaaacuguacgaagaacugaaggacaacggcuacaagacccuuuacagcaaucaguacaucccgaaggagaaggucuucagcaaggagaucgacaucgagcacaucaucccccaggcccgccuguucgaugacucccugagcaacaagacucucgaguacaaagccaucaauaucgagaaaggcaacaagaccgcauacgacuuugugaaagaaaaguacggggagaagggccuacaacaguaccugaaccgaugcgaguccuuguucaagggucaccgcaccaagcugcggaagcugaaaaugggccaagagaacaucccggagggguucaucgaccgagaccucagaaacacccaguacaucgcgaagaaagcccuggcgaugcugaacgagaucugccgucggguggucgcuacgaccgggagcauaaccgaccgccuccgggaggacuggcagcugguggacguguuaaaggagcucaaccuccccaaguacgagacccugggccucguugagguuuacgaggacaaggacggccgcaagaucaagcggaucaaggacuggaccaagcgcaacgaccaucggcaucacgccauggacgcacugacgguggccuucacgaaggacgucuucauccaguacuucaacaacaagaaugcggccuggcaggccgauugcaaggagcacuccgacaucaucgguaucaagacccgcuacuucgagaacgggcgggcccugccgcccaugccccucgugcgcuuccgggccgaggccaagagccaccuggagacccuacucguguccaucaaggcgaagaacaagguggugacgaacaacgugaacugcaccaagcgcaaggguggggagaacaagaaacuucaacagacgcccagaggccagcugcaccucgagaccaucuacggcagccaccgccaguaugucaugaaggaggaaaaggugaacgccuccuucgacagcuccaagauugccaccgugugcaagcaggcguaccggaacgcucugcuggaaagacucgccgcauucgggaacgacccgaagaaggcuuucaccgggaagaacagccuagagaagaauccugucuaccuggacagagaacagacugcgcgggugcccgagcgcgugcggaccguggaacuugagacgguguacacgauucgcaagcccguggacccgaaucuguccgucgacaaggugguggacgccaagguccggagcauccuggagcagaggcuccgggaguaugauggcgaggccaagcgcgcauucgugaaccuugacgagaaccccaucuggcugaacgaggaaaagggcaucgccaucaagcggguaaccauacgcgguaucaacaagguccagucucuccacggcaaaaaggacaagaacggcaaccugaucuuagacgagaccgggaagaagauccccguggacuucgugaacacgggcaacaaccaccacgucgcuauuuaccggaagccgguucucgacaagaccgggcaggagauguuggacaacgagggcaaccccguuuacgagcuggacgaggucguggucagcuucuucgaggcggugaccagggucaaccuggggcugccugucaucgauaagaacuacaacaaguccgagggcuggcaguucauguucacuaugaagcagaacgaguacuucguguuucccaacgagaagacgggauuugacccgaaagagguggaccugcucaaucccgagaacuacgccgucaucagccccaaccuguuccgggugcagaaaauuaccgagaaggacuauauguuccgccaccaccuggagaccaagguggucgacgacaaauuccucaaagagaucacuuggaagcggauccugacgcccaacaagcuggaagggaucgugaagguucgagugaaccacauugggcagaucgugagcgugggggaguacuga

SEQ ID NO: 7991 - RNA, 4299 nt, Artificial Sequence
  Cas9 variant
augaagaaaauccugggccuugaccuggggagcaacuccaucggcugggcccugguuaacgaggccgagaacagcgacgaggucuccagcaucaucaaacucggaguucgcgugaauccccugaccgucgacgagaugcagaacuucgagaagggcaaguccaucaccacgaacgcggaccggacccugaagcgcuccaugagacgcaauuugcagcgguacaaacuacgccgggacgcccugaucaagcuccugaagaaggugggguucaucaccgauggcacaauccugagugaacagggcaacagaacgaccuucgagaccuaccgucuccgcgcuaaggcccccgacgaggagaucagccuccaggagcuggcccgagugcucuugaugauaaacaagaagaggggguacaaguccagccggaagaucaaagagaaggaggcgggcacgcugaucgacgggauggaggucgcuaagaagcuguacgacgaggaccugacgccgggccagcugugccuccagcugcuggaguccgggaagaagucccuccccgauuucuacagcagcgaccugcaggaggaguucgaucgcaucuggaacuuccagaaacaguucaaccccaaagcguucugcgacaccgccaaggaggagaucaagggcaagaacaaaucccagaccugggcgauccuggccaaguacuucaucuggaccgaugagauggugguguggaacgagaaggagagcaagacugagcgggucgagaaggagugcaagcucgugggccugaagcgcaccgugaagaaggaggagcagcggaaggagaacuacugcuggcgcgugcaggcccugaccgaacagcucgaccuggagaagguagccgugguccugcaggagaucaacgggcagauuuccaccagcaguggcuaccuuggggccaucagcgaccguagcaaggugcuguacuucaaccgccagacggugggccaguaccagauggcggagcuggagaagaacccgaacaccagccuacggaacauggucuucuaccgccaggacuaucuggacgaguucgacaagaucugggagaagcaggcggaguuccauaaggagcugaccguggagcucaaaaaggagauccgcgacaucauuaucuucuaccagcgacgccucaagagccagaagggccugaucggguucugcgaguucgaaaaccgcgagaucauggucgaaaagaacggaaagaugcaggccaaggucguggggugcaaagugaucccacgcucccauccccucuuccaggaguucaagaucuggcagacccugaauaacguagagguguucgcuggugaaaagaaguguaagcguaaacgcaccgacgccuuccccggccuguucgaugggaccgaggauacccucauggucgagggcuggcgguaucuguaccaggaggagaaggagauacuggcgaaggagcucagcgugaagaagucccugaagaaggaauacauccugaaguuauuauuugacaauccgcaggaccuggacaugaacuucgagcagaucgaggguaacgacaccggcaacgugcuguucagcgccuacucgaagaugaucgagaaguacggauacgagccauuggacuucggcaagcccacggacaagaucaucgagcagcuucaggugaucuucgcagaccuggguuggaacaccgaccuccuguucguggaccugaacaaggagggcaaggaccuagagaagcagcccuacuucaagcuguggcaccuccuguacagcuucgagggcgacaacaccccgaccgguaauggcaagcuggucgaaaagcugauggagcucugccacgucgggaaggagugcgcccuugagcuggugaacaucucguuucagaacgacuacgggagccucuccgccaaggcgaucaagaagauccuucccuaccugaaggaggggaaccgcuacgacguggccugcggcuacgcgggcuacagacacagcaaguccagccucacgaaggaggagaucgagaacaagguacuaaaagacaagcuggacauccuccccaaaaauucccuccgcaaccccgugguggagaagaucuugaaucagauggucaacguaaucaacgccauaaucgacaccuacgggaagccggaugaaauccgcguggagcucgcucgcgagcugaaaaaguccgcgaaggagcgggaggagcuuaccaaggccaucgccaagaguacccgugagcacgaagagauccggaaaguucugcaggaggaguucggcaugaucaacgugagccgcaacgacaucauccgguacaagcuguaugaggaacugaaggauaacggauacaagacgcucuacuccaaccaguacauacccaaggagaaaguguucuccaaggagaucgacaucgagcacaucaucccccaggcccgccuguucgacgacucacugagcaacaagacucucgaguacaaggcgaucaacaucgagaagggcaacaagaccgccuaugacuucgucaaggagaaguacggggagaaagggcugcaacaauaccugaaccggugcgagagccucuucaaaggccagagaaccaagcugaggaagcuaaagauggggcaggaaaauaucccagagggcuucaucgaccgggaccuccgcaacacgcaguacaucgccaagaaggcgcuggcgaugcugaacgagaucugccggcgcgugguugcgaccaccggguccaucaccgaccggcuccgcgaggacuggcagcugguugacgugcugaaggagcucaaccugccgaaguacgagacccuggggcucguggaggucuacgaggacaaggacggacggaagauuaagcgcaucaaggacuggacgaagcggaaugaccaccgccaccacgccauggacgcacugaccguggccuucaccaaggacguguucauacaauacuucaacaacaaaaacgccgcguggcaggccgacugcaaggagcacagcgacaucauagggaucaagacccgguauuucgagaacggccgcucccugccgcccaugccccucguucgguuccgcgccgaggccaagagccaccuggagacgcugcucguguccauaaaggccaagaacaagguuguaaccaacaaugugaacugcaccaaaagaaagggcggggagaacaagaaacugcaacagagcccccgcggacagcugcaccucgagaccaucuacggcucccaccggcaguaugucacgaaggaagagaaggucaaugcuucguucgacuccagcaagaucgccaccgugugcaagcaggccuaucgcaacgcgcuucuggagcggcucgcugccuucggcaacgaccccaagaaggccuucaccgggaagaacucccuggagaagaaccccguguaccugaaccgcgagcagaccgcccggguccccgagcgcguacgcaccguggagcuagagaccgucuacaccauccggaagccgguggacccaaaucuuaguguggacaaggucguggacgccaaggugcgcuccauccuugagcaacggcuacgcgaguaugacggcgaggcgaagcgggccuucgucaaccuggacgagaaccccaucuggcugaacgaggagaaggggaucgccaucaagcgugugacaauccggggcauuaacaagguucagagccuccauggcaaaaaggacaagaacggcaaccugauccuggacgagacgggcaagaagauccccgucgauuucgugaacaccgggaacaaccaucacguggccaucuaccgcaagcccguccucaacaagacaggccaggaaaugcuggacaacgaggggaaccccguguacgagcuggacgaggucgugguguccuucuucgaggccgucacccgggugaaccucggccugcccgugaucgacaagaacuauaacaagagcgagggguggcaguucauguucacgaugaagcagaacgaguauuucgucuuccccaacgagaagacccgcuucgacccaaaggagguggaccugcucaacccugaaaacuacgcgguuaucagccccaaccuguuccgcgugcagaagaucaccgagaaagacuauauguuccgccaccaccuggaaaccaaggugguggacgacaaguuccucaaggagaucacguggaagcggauccugacaccgaacaaguuagagggcauagucaaagugcgagugaaccacaucggccagauugucuccgugggugaauacuga

SEQ ID NO: 7992 - RNA, 4299 nt, Artificial Sequence
  Cas9 variant
augaagaacauccugggccucgaccuggggaccaccagcaucggcuucgcccacaucguggaggacgagaacaaggagaaguccgagauuaaggagcuggggguccgcaucgugagccucacaaccgacgagcaauccgacuucgagaagggcaagagcaucaccaccaacgccaaccggacgcugaagcacggggcgaggcugaaccucgaccgguaccagcagcgccggaaguaccugaucgaccugcuccacaaggccaaccugaucacccccuccagcauccuggccgagaacggcaagaacaccacccacuccacguggcagcuccgcgccaaggccgugaccgagcggaucgagaaggaggaguucgcgcgcauccugcuggccauuaacaagaagcggggcuacaagagcucccgcaaggccaagaccgaggacgaggggcaggccaucgacggcauggcgaucgcuaagcgucucuacgacgagaaccugaccccggggcagcugagcuuacagcugcugcagcagaacaagaagcuccugcccgauuucuaccgcuccgaucuccagaaggaguucgaccucgucuggaacuuccaaaaacaauucuaccccgacauccugacggacaucuucuacaaggagcugcagggcaaggggaaggacgccaccagcaaggccuucuccaagcgguaccacuucgacaccgccgagaacaagggcagcaaggaguccgugcgccuccaggcguaccaguggcgggccgaggcggugagcaagcagcuguccaaggaggaagucgccuaugugcugaccgagaucaacaacaaccucaacaacgccagcggcuaccugggcgcgaucuccgaccgcucuaaggagcuguacuucaaccggcagacggucggccaguaccucuacgcccagcugcaggagaaccgccacaacagccugaagaacaaggucuucuaccggcaggacuaccucgacgaguucgagcgcaucugggagacccaggcccuguuccacaaggagcugaccgacgagcucaaaaagcagauccgggacguggugaucuucuaccagcguaagcccaagagccagaaggggcugaucagcuucugcgaguucgaguccaaggagaucgagaucgagaaggacgguaagaccaucacgaagaacaucggggcccgcgucguccccaagagcuccccgcuguuccaggaguucaagaucuggcagauccucaacaacguuaucugcaagcggaaggggauccgcaagaagaagaucagcgccaagaccacccagcuggaccugcuuaacgaguccagccagaccaucuucucccuggauauggagugcaagcaacugcuguucgacgagcugaaccugaagggcgaccucaagagcgacaagguccucaagcugcugggguacucuccccaggagugggagaucaacuacaaccagcucgagggcaaccggacgcagaaggcgcuguacgaggccuaccugaagaucguggagauggaggcccacgacgugaaggacauccuccaaaucaaaagcaccaaagacgacuggucccuggacgagagcccacuguccgccagcgagauccgcgaguccgucaaggccauauuccaggcgcucgggaucugcaccaagauccuguacuucgacccgcugcuccccgugaaggacuucgaggagcaggacagcuaccagcuguggcaccuccucuacuccuacgagagcgacgacagcaccuccggcaacgagacgcuguaccggaucuuggagaagaaguacgccuucaagcgcgagcacgcccggauccucgccaacguggcgcugcaggacgacuacggcagccuguccaccaaggccauccgcaagaucuaccccaacaucaaggagaaccaguacagcaccgccugcgagauggcaggguacaagcacucgaagcucagccugacuacggaggagcuggaggcccgcgagcucaagaacaucaucccccugcugaagaagaacgcgcuccgcaacccgguaguggagaagauccugaaccagaugauuaacguggucaacgcccugaucgagaaaaacucagagcgggacgccgagggcaagaucaccaaguacuuccacuucgacgagauccgcaucgagcucgcccgggagcugaagaagaacgcccagaagagauaugagaugacccagaacaucaauaaggcgaagucggagcaccagaagaucuccgagauccugcagaaggaguucgggaucaaaaaccccaccaagagcgacauuauccgguaccgccucuacaaggagcuggagcacaacggcuacaaggagcuguacacgaacaccuacaucgccccugacgugcuguucuccaaaaacaucgacaucgagcacaucguccccaaggcccggguguucgacgacagcuucuccaacaagacccuggccuucaaggacuucaacaucaagaagggggagagcaccgccuucgacuacaucaccucacugaagaacgaggagaagcucaaccaguaccuggcgcgcguggagaacgcauacaagacgaagaacaucagccccgccaaguacaagaaccuguugaagaaggccuccgagaucggcgacggcuucauaaaccgggaccugcgcgacacccaguacaucgccaagaaggccaaggagauccuguuccaggucaccaagaacgugcucagcaccuccggguccaucacggaccgccugagagaggacuggagccugguggacgucaugaaggaguuaaacaugcccaaguaccagucccugggccugaccgagguggaggagcgcaaggacgggaacaaggugaccgucaucaaggacuggaccaagcggaacgaccaccgccaccacgccauggacgcccucacgguggccuuuacuaagcccagcuacauccaguaccugaaccaccugaacgcgcggaaggacgagaacaauaagaacuacuccgugauacucgcuaucgagaagaaggagaccaucaagguccccaccaacaacggcaagaacaagcgcguguucaucgagccgauccccaacuuccgccagguggccaagaagcaccuggaggagaucuucauaagccacaaagccaagaacaaggucgucacgaagaacaccaacaagcccgccggaaccaacaagcagcagaucacccugacgccccggggccagcuccacaaggagaccaucuacggcaaguaccaguacuacgugaacaaggaggagaaggucggggugaaguucgacaaggagaccaucgcgaagguguccaacccccuguaccgggaggcccugcucaagcgccugcaggccaacgacaacgaccccaagaaggccuucaccggcaagaacgcccugagcaaaaaccccaucuaccuggacgaggcgaagacgaagacccugccagagaaggucaaccugaccuaccucgaagaggacuuuuccgugcggaagaagaucgugccgaagaaccccaccagcaaggaguucguccccaaccugaaguccaucgagaaggucguggacgaggggguccgcaacauccugaucgagcggcuacgcguguacaacaacgacccggagaaggccuucguggaccuggagaagaaccccaucuggcugaacaaggagaagggcaucgccaucaagcgggucacgaucagcggcgugaacaacgcccagccccuccacaucgggaaggaccaccugggcaagaccacccugaacaaagaggggaaggagauccccguggacuacgucuccaccggcaacaaccaccacguggcgaucuaccgcgacaaggaggggaaccuccaagagcagaucgugagcuucuucgaggccgucgugagaacgcagcagggccugccgaucaucgacaagaccuacaagcaggaggagggcuggcaguuccuguucaccaugaaacagaacgagauguucguauuccccaaugaggccaccggguuuaaccccgccgagaucgaccuccuggaccccaagaacaagaagcagaucuccccgaaccuguuccgcguccagaagaucgccacgaaggacuacuucuuccgccaccaccucgagaccaacguggagaccgacaacgugcugaagaacaccacguggaagcgcgagggcuuaagcgggcucaaggacaucgucaaggugcggaucaaccaccugggcgacaucguguccaucggcgaauacuga

SEQ ID NO: 7993 - RNA, 4302 nt, Artificial Sequence
  Cas9 variant
augaagaagauccugggccuggaccuggggaccacuagcauaggguaugcccaggugaacgaguccgaggacuucaaggacagcuccaucgagcgcaucgggguccgggugaacccccugagcguggacgagcagacgaacuucgagaagggcaagccgauauccauaaacgccgaccgcacccucaagagcggggcgcggcgcacccuggaccgguaucaggaccgccggagcaaccugaucgacgcccucgucaagagcgugaucaucaccgaggacacggugcuggccgaggacggcaagaacaccacccacuccaccuucgcccuccgcgccaagagcgcguccgagaaggucgagaaagccgaguucgcccggauccuccuggccaucaacaagaaacgcggcuacaagagcucccggaaaacgaacaacaacgacgacgaagggcaggcgaucgacggcauggccaucgccaagaagcuguacgacgagaaccucacgcccgggcagcuggccuaccagcugcucaaggagggcaagaaguaccugcccgacuucuaccgcagcgaccuucaggccgaguucgacaagaucuggaccuuccagaagcaguuuuaccccgagauccucaccgacgagcugcagaaggagcuggcggggaagggccagcgggccacguccgcgaucuucuggaagaaguacgacuucaacaccgccgagaauaagggcacccgcgaggagaaaaagcucaaggccuacgaguggcggagcaccucgguggacaagaagcugcagaaggaagagguggcguacgucaucacggagaucaacaacaaccugaccaacucuuccggguacuuaggcgccaucagcgaccgcagcaaggagcuguacuucaacaagcagaccguggggcaguaccuguucaagcagauccagaagaauccgcacaccaagcucaagaaccagguguucuaccggcaggacuacuucgacgaguucgagaucaucugggagacgcaggccaaguuccaccccgagcugaccgaggagcugaaaaacaagauccgcgacaucaucaucuucuaccagcggaagcucaagucccagaagggccugaucagcuucugcgaguucgagcgcaaggaggucgagaucgagaagggcgggcggcgcaugaagaagaccaucggacugaagguagcccccaaguccagcccccucuuccaggaguucaagaucuggcaggucuugaacaacgugcugauccgcaagaagggguccaagaagcggcgcgugaaggagccggaccagcucaaccugguggagcaggagcaggaggucauguucuucgacaugcagaccaagcagacgcuguucgacgagcucaacgugaagggcaaccugaaggccaagcggaucaucgagcugaucgggcaggacgcgaacgacugggagaucaacuacagcgagaucgagggcaaccgcaccaacaaggcccucuacgacgccuaccugaagauccuggaccucgagggcuacgacaccaaggcccugcuggacgugaagaccuccaaggacgaggucgagcucgacgacaucaacaucagcgggcccgaggugaaggaccuggugaagcguaucuucgagucccuggagaucgacacgcagauccuggaguucgacgccgaacucgacggcgaggucuucgagaagcagagcuccuaccugcuguggcaccuccuguacagcuacgaaggggacgacucccccagcggcaacgagaagcuguacaagcuccugaagcagaaguucggguucaagaaggagcacgcgcagauccuggccuccaucacccucucagacgacuacggcucccugagcgccaaggccaugcgcaagaucuaccccuacaucagggagcagaccuucgacaaggcggccucccuggccggcuaccgccacagcgccagcucccucaccaaggaggagauugccaaccggccgcugaaggacaagcuggagcucaucaagaaaaacagccugcgcaaccccguggucgagaagauccugaaccaggugguaaauaucgucaacaguuugaucgaggcgaacagcgagaaggacuccgacgggaacaucaucagcuacuucaaguucgacgagauccggaucgagcuggcccgcgaccugaagaagaacgccaaggagcgggccgagaugacgcucaacaucaacgccgcgaagaucgugcacgaaaagaucuucaagcugcugcaggccgaguucggcgugaagaaccccacccgcaacgacaucauccgguacaagcucuacgaggagcugaagaacaacggcuacaaggaccuguacaccaacauauacaucccccgcgagauccucuucuccaagcagaucgacaucgagcacaucaucccgcagagcaagauguucgacgacuccuucagcaacaagaccaucgucuuccggaaggacaaccuggacaagggcaacuccaccgccuucgacuacaucgacagccgcuucgggaaggacaagcugaccgacuucgagcagcggaucgaguuccucuucgagcagggcaagaaaaacaaggaagagggcaucuccaaggccaaguaccagaagcugcugaagcgcgaggccgacaucggggacggcuucaucgagcgcgaucuccgggacacccaguacaucgcgaagaaggcccgcaaccugcuguacgagaucugccgcaucgugacccccaccacggggagcaucaccgaccgccuccgggaggacugggaccuggugaacaucaugcaggagcugaaccucgacaaguucaagaaguugggccugaccgagauggucgagaagaaggauggcuccuucaaggagcgcaucguggacuggagcaaacggaacgaccaccgccaccacgccauggacgcccucaccaucgcguucacgaagcacucccacauccaguaccugaacuaccugaacgcccggaagaacgagaaccacaagcagcaucacaacaucaucgggaucgagcgcaaggagaccgaguucgugaucgacgaccucggcaacaagaagcggaaauuccaccucccccugcccaacuuccgcgaggaagccaagaagcaccuggagaacguccuggugagcuucaaggccaagaacaagguggucaccaagaacaagaacaagaccgccagcuccaagggggagaagaucaagguggagcugacaccgcggggccagcuccauaaggagaccguguacgggaaguacaaguucuacgucagcaaggaggagcgcaucggcggcaaguucgaccagcgaaccaucgagcgcguggcgaacuccacccacaagcggcugcugcuccagcgccugcuggagaacgauaacgacgccaagaaggccuucacggggaagaacgcccucgccaagaaccccaucuaccuggacgacaccaagacccucacccuccccgagaucgugaagcugacguggcuggaggaggacuacagcauccggaaggacaucacccccgagaacuucaaggacaucaaggucaucgauaagauccucgacgagggcgugaagcgcauacugaaggagcggcuggcgaagcacaacaacaacccgaaggaagccuucuccgacuuagagaagaaccccaucuggcuuaacgagaagaagucgaucagcaucaagaaggugaagaucagcgggaucaacaacgcugaggcccugcacuauaagaagaaccaucucggcaucgagauccuggaugacgagaagaagcgcauccccgucgacuucguguccacagggaacaaccaccauguggccaucuaccgcgacgagaagggcaaccugcaggaggacgucgugagcuucuucgaggcgguggcccgggucaaccagaaccuccccaucaucgacaagacccugaaggccuaccugggcuggacguuccucuucaccaugaagcagaacgaguacuucauuuucccgaacaagcagaccggguucaaccccaccgagaucgaccugcuggacuccaugaacaacaagcucaucagccccaaccuguuccgcgugcagaaauucacggugaaggacuacuucuuccggcaccaccuggagaccaacgucgaagacgacuccaagcucaagaacaccaccuggaagcgcgagggccucgggggcauugggaacaucgugaaggugcggaucaaccacaucggccagauagucaagaucggcgaguacuga

SEQ ID NO: 7994 - RNA, 4305 nt, Artificial Sequence
  Cas9 variant
augaagaacauccugggccuggaccuggggaccaacagcaucggcugggccuacguuaagcaggcccagaacgacuccgagaaguccgagaucgcggaacuggggguccgcguaaacccccucaccguggacgagaaaacgaauuucgagaagggcaagccgaucagcaccaacgccgaccgcacucugaagcgcggggcccggagaaaccugcagcgguacaagcuccgccggcaggagcucauagagcugcucaaggacuaccaagucaucagcgacaagaccauccuggccgaggacggcaaggagacuaccuucgagacacugcgccuccgggugaaguccgccaaggagcaggucagccuggaggagcuggcgcgcauccuccugaugaucaacaaaaagcggggauacaaguccagccgcaaggccaagaacgaagacgaggggcagcugaucgacggcauggagaucgcccggcgccucuaugacgaaaaccugaccacggggcagcugucgcuccagcugcugaaggagggcaagaagucccuccccgacuacuaucggagcgaccugcagcacgagcuagacaagguguggaacuuccagaagcaguuccaccccgacauccucaccgacgaguucuacaccagcauccaggggaagggccagaaggccacccgcgaguccuucuccuccaaguacggcauugacacggcggagaacaaggguagccgggaggagaaaaagcugcaggccuaccaguggcgcgccgacgccacccacaaggagcugaccaaggaggaacucgccuucgugaucaccgagaucaacaacaacaucaacaacuccagcggcuaccuaggggcgaucuccgaccggagcaaggagcugaucuucgccaacgagacggugggcgaguaccucuggaagcagauccaaaacgacccccacaccagccugaagaaccaggucuucuaccgccaggacuacuucgacgaguucgagcggaucugggagacccaguccggcuucuacccgcagauccugaccgagagccucaagaacgagcugcgcgacauccugaucuucuaccagcgcaagcucaagucccagaaggcccuggugagcaucugcgaguucgaguccaaggagaucccccugaaggacaagcaggggaaccccaucagcaagaacggcauccccgugacgaagcucgucgggccgaagguggcccccaaguccagcccccuguuccaggaguucaagaucuggcagaaccucaacaacgugcucguccggcccaagggcucccgcaagcggaaggugaccaccaaccagcagagcacccugcuggaggggcaggagccgguguucgagcucaaccuggagcagaaggagcuucuguucgaggagcucaaccugaagggcaaccugaagacggacuacugcuuggagcugaucggcuacuccgccaaggagugggagaugaacuaccccacccuggaggggaacaagaccaacaaggcgcucuaugaggccuaccuuaagauuaucgacagcgagggcuacgacgccaagaagcugcucaaggucaagaccgacaaggacgacaucaaccuggacgacaucaagguauccgccagcgagaucaagaccaugaucucggacaucuucaacgagcugggcaucaacaccaagauccucgacuucgacgcggagcuggagcgcaagcaguucgaggcgcaggccagcuaccggcuguggcaccuccuguacuccuacgagggcgacgacagcaaguccgggaacgagcugcucuaccgccugcuggaggacaaguucggcuucaaacgggagcacagcaagacccucgccaacgugagccugcuguccgacuacggcaaccucagcaccaaggccauccgcacgaucuaccccuacaucaaagagaacaaguucuccaccgccugcgagcuggcgggguaccggcacagcaagcucuccaucagcaaggaggagaacgaaaaccguacccucaaggacacccuugacguccugaagaagaacucccuccggcagcccgucguggaaaagauccugaaccagaugaucaaccugaucaacgagcucaucgagaagcacagcgagaaggacgagaaggguaacaucgucaaguacuucaaguucgaugagauccacaucgagcuggcccgcgagcugaagaaaaacgccgaggagcggcgcgagcucgacuccaaggugcgggaggggaaggaccgcaacgagaagaucaucacgauccucaagagcgaguucggccugccguacccgaccaagaacgacaucacccgguaccgccucuacgaggagcugaaggacaacggguacaaggaccuguacaccaacaccuacaucccccgggagaagcuguucuccaaggagaucgacaucgaacacaucauccccaagagccgccuguucaacgacuccuucagcaacaagaccaucugcuaccgccaggacaaccugaacaagggcgagcggaccgccuacgacuacaucgagggccucgggaagacccagcuggacgaguaccugaaccgcgucgaaaaccucuacaccaacaaguucaucacgaaggcgaaguaccggaaccugcugaagaaggaguccgaaaucggcgauggguucaucgagcgcgaucuccgggagacccaauacaucgccaagaaggccaaggagaugcugcugcagaucacccgccacguggugagcaccacgggcuccaucaccgaccggcuccgcgacgauugggagcuggucaacgugaugcgggagcugaaccuccccaaguacaaggugcugggccugaccgagauccaggagcgcaagaacgggcagaccgucgaggugaucacggacuggaccaagcggaacgaccaccgccaccacgccauggaugcccucaccguggcguucaccaagcacagccacauccaguaccugaacuuccugaacgccaggaaggacgagaagcacaaggaguacagcaacauuaugggcauccagcagcucgagacggagaagaccaccgacaaggacgggaaggaccgccgggucuucaagacccccauccccaacuuccgccagguggccaaggagcaccuggaguccauccugaucagccacaagacgaagaacaagguggucacacgggccaccaacaagaucgccggcuccaagaagcagcaggagacccugagcccccgcgggcagcugcacaaggagacgguguacggcaaguaccggcgcuacgugcagaaggaggagaagaucggcuccaaguucgaccugcaaaccaucgagcgugucgcgaacccgcucuacaagcgccugcugaccaagcgccucgaggagaacggaggcgaccccaagaaggccuucaccgggaagaacgcacuggccaagagccccaucuaccuggacgagacgcagacccagcagcucccugagaaggugaaguugguguggcuggagaccgacuucuccauccggaaggacaucaccccggacaacuucaaagacgagaaguccaucgacaagguccucgacgagggcaucaagcgcauccugaaggaccggcucaagagcuucgacggggacgccaagcgcgcguucacggaccuggagcagaaccccaucuggcugaacaaggagaagggcaucgccaucaaacgggugaccaucagcggcguguccaacgccgagccccugcacaccaagaaggaccaccucgggaacgagaucuucgacgacaccggcaagccgauccccgucgacuacguaagcacggggaacaaccaccacaucgccaucuaccgcgacgagaacggcaaccugcaggagaaggcgguguccuucuucgaggccgucacccgggccaaccaggggcugccaaccguggacaagaccuacaaccagcaccucggguggcaguuccucuucaccaugaagcaaaacgagauguucguguuccccaacaaggagacgggcuucgacccgcaggagaucgaccugcucgaccccaagaacaagaagcugaucagccccaaucuguuccgcguccagaaaaucuccaccaagaacuacuucuuccggcaccaccucgagacgagcguggagacccacaacgcccugaacggggugacguacaagucccagcugggacugaacgggaucaccgacaucaucaagguccgcaucaaccaccuaggcgacaucgugcacauaggggaguacuga

SEQ ID NO: 7995 - RNA, 4308 nt, Artificial Sequence
  Cas9 variant
augcugggcugcgaacgcaagcggaagcggcgggagaaagagaaaauggcaaagcccaaggacuacaccauaggucucgacaucggcaccaacagcguugggugggugguuacugacgaccaaaacaacauauugcgcaucaagggcaaaaaggccaucggggcgcggcuguucaccgaggggaagguagccgccgagcgccgguccuuccgcacuacccggcgccggcucagccgccggcgcuggcggaucaagauguuagaggaguuguucgaugaggaaaucgccaaggucgauccgucauucuucgcccgccuccacgagagcuggaucucccccaaggacaagcggaagcgcuacucagcgaucguguuccccuccccugaggaggacaaaaaguuccaugaaagcuacccgacgaucuaccauuuaagggacaaacugaugaaggacgaccagaagcacgauauucgcgagaucuacaucgcugugcaccagaugaucaaggccaggggcaacuuccugcacgacgaguccgucgagaccuaccgcagcgggaugucaagccuuggcggucgcuccgaacggaauaucuuaagcguccagacacucgaggagcugaaugaucuguucgccgaaaacgaaggcaccgaggagguagagcucaacgucgcguccgccgaacagauuaacgacauccugaccgggggucaccugaacgcggacagccagaaggaaaucuccaaccuccugcugcccagcuccuuccccucguuugaugacaaggccaaggagaagcaggucaagaagcucaucaacaacguagccacgaauaucagcaaggcuuggcugggcuacaaggccgacuucuccacgauccugaaccucgccaagguggauaaggaccagaagaagaucuucgccuucgcccugcaggguggggacgaagaggacaagguccaggagcuggagagccucuuagagcaaucccagacagauauaguggaucgccuuaucgagaucagacacgcgaucguccucagcgaaaucguucccguggggaugacgcugucugaggccaugaucgauaaguacgaccagcacaaggaagaccugaucacccucaaggccguuauccgcaacacuaaagacaagaagaaggcagccaagcuccaggcgaucuacgacuuguacgucaagaaccggcacgcagaccucgcuaaggccaugaagcugaccggcauaaagaagaggucggagcugcuugaccccgaagaguuaaagaagggcaucuccucucugcuagacgacucccccgaggcaguggagaucaaacaacgguuggaggagaagacguuccugccccuccagcgcagcaauaacaacggagucaucccuaaccagcugcaccagguggaguuagacgagaucaucaagaagcaguccaaguacuauccguuccucgcugagaagaaccccgacgagagcgaggaggcccagaagaaggccccuaccaagcuggacgcgcuucuaaccuuccggguccccuacuacgucggcccaaugauaaccaaggaggagcaggaagcgcagaacggacacuccuucgcuuggaugguucgccgggacccccaggaccacgaggcuaucacgccuuggaacuucgagaagaaggucgacaagauggccagcgcgacccaguucaucaaaagaaugaccaccaaggacacguaccuccugggggaagauguccugcccgcgaguagccucaaguaucaacuguuuaccgugcugaacgagcucaacaaccugcgggucaacgggaagaagcugacgagcgacgaaaaggagcaggucaucgagggccucuucaagaagcagaaaaccgugaaggccgacaaguucguaaaguauuggcaggccaagcauauaggcgccgacaucaaggugaaggggcucagcgacccguccaaauucaacagcacaaugagcacguacaucgacuucaagaagaucuuuggcgaccaacugaacgacgugaaccgccagaacgacuuugagaaaauaaucgaguauuccacgaucuucgaggacaggaagauccucgaggacaagcugcgcgucgacuucgcuuggcugagcgaggagcaaaucaagcagcucugucgccugagacugcagggauggggccggcuauccgacaagcugcugacacgccucacggaugccgacggccagaacguccuggagcgccuguggaacagcaacgacaacuucgugcagaucguuuccgacccgaacauuaaggccaagaucgagcaggagaaccagaaguuacugcgggauagccaguccgauaacgccgucgagagcauccuagacgaugccuacaccagcccgcagaacaagaaggcaauccgccaggucaugcggguuguacacgacauugugaaggcgugcgacggcaacguccccgcgaaguuugcuaucgaguucgcacgcucccaagaagaugacccgaagagaaccacugcgaggguaaaucagaugcagaagaucuacgaccagaucucugacgaggugguuagccaggguguuaaggagcagcucuccgguaugaagucgcugaaagaccgguacuaccuguacuucaugcagggcgggcgagaugccuauacgggcgccaagcucaacaucgaccggcucuccgacuacgacguggaccacauaaugccgcagagcuucguaaaggacgacuccuuagacaaccgagugcucguggcccgggccgucaacaaccaaaagucggauaaggugcccgcgcugcuguucgggaacaagguggucgccgaucucggcaucaccgugcgagagaugugggauaaguggcagaagcugggcaugauuagcaagcgcaaacuuagcaaccuccugaccgacagcgacgcccugaccgaguaccgcgcccagggguucauucgacgccagcucgucgagaccucucaggucauuaagcugacggcaaccauccugcaaucagaguucccugacuccaagauaaucgagguccccgcgaaguacaacagcaucgugaggaagcaguucgaucucuacaagucccgcgagguuaacgacuuucaccacgccaucgacgcauaccuguccaccaucgucgguaacuaccuguaccagguguacccuaaccuucggaggauguucgucuauggggaguucaagaaauucuccuccaaugcggaggaguccgcccacgacguagcgcggcgcguaaaaagcaugaacuuccuggacgaucuccuccgaggcacccacggcgauaacaucuauugccgguccacgggggagaucguguucaaccgcaacgacaucaucagcaagcugaagcaggccuacuccuucaagcagaugcuggugacccaggagguguucaccaagaaguccgcccucuuuaaccagaccgucuaccccagcccgaaacgggacggcagcaagcgcuccgggcugauccccaggaaaagaggcauggaccccgagauauacgggggcuacgcccacaaccaagauagcuacuuuguacucgcuaagaucgagaaagugaagggcuacacgcuccagaucguuggagugccuauccggagcuuagagaucaucaacaaggccgaggacuucagcaccgccuuacuggacaucaucaaaagcaaggugauguacaacgagaagacuggccagccgaagagagggaucaagaacgucgaaauccuggugaauaaacugcccuaccgucagccuauacucgagaaggacgucuccuacaugcuaggcuccuccgccuacaaguacaacaucaagcagaucacccugagcagacaguccaugaaguacauccucgacuacauagacgaccccaacuucacgaagcaugagaugaccaugaucgacgagcagaacgaacgggagugccugcugagcguuuaugacgaaauccucgagaaagucgacaaguaccugccccucuucgacgggaacaaauuccgcgaaaagcuccacuccgcccgaaaggaguuugucagcuuauccguggacgacgaggcgagcgccaucgaaaagauccuucgcggccuccacgccaacuccgagaugccgagccuggagaaccuaaagaucaaacccgcccucggcuucuuccagaugaagaacgggaucacccuauccaaugaugccguucuacucuaccaaagccccaccgggcuguucgaacggcgcgucaaggugagugaccugcucaaguga

SEQ ID NO: 7996 - RNA, 4308 nt, Artificial Sequence
  Cas9 variant
augaagaauauccugggccucgaucuggggacaacauccaucggcuucgcccauauaguagaggacgagaacaaagagaagucugaaaucaaggagcuggggguccgcaucgugccccucacgaccgacgagcaaagugacuucgagaagggcaaguccaucaccaccaacgccaaccgcacgcugaagcacggggcgcgccugaaccucgaccgguaccagcagcgccggaaguaccugaucgaucugcuccaaaaagccaaucugauaaccucguccagcauccuagccgagaaugguaagaauaccacccacuccacuuggcagcuccgcgccaaggccgugaccgagcggaucgagaaggaggaguucgcccgcguccugcuggccaucaacaagaagcgaggcuacaagagcucccgcaaggcuaagaccgaggacgaggggcaggccaucgauggcauggcgauagccaagcgacucuacgacgagaaccugacgacggggcagcugagccuccagcugcugcagcagaacaagaagcuccugccggacuucuaccgcuccgaucugcagaaagaguuugaccucguguggaacuuccaaaaacaguucuaccccgauauucugaccgacucguucuacaaggagcugcagggcaaggggaaggacgccaccagcaaggccuucucaaagcgguaccacuuugacaccgccgagaacaagggcuccaaggagagcgugcgccuccaggcguaccaguggcgggucgaggccaucuccaaacagcugagcaaagaagaaguggccuacgugcuuacggagaucaacaacaaccucaacaacgcgagcggcuaccugggggccaucagcgaccgcagcaaggagcuauacuucaaccggcagaccgucggccaguaccucuacgcgcaacugcaggagaaccgccacaacucccugaaaaacaagguguucuaucggcaggacuaccucgacgaguucgaacgcauaugggagacccaggccagcuuccacaaggagcuaacggaggagcugaagaagcagauccgggacguuguaaucuucuaccaacgcaagcccaagagccagaaggggcucaucagcuucugugaguucgaauccaaggaaaucgagauagagaaggacgggaagacgaucacaaagaccaucggcgcccgcguggugcccaagagcagcccccuguuccaggaguucaagauauggcagauccugaacaacgugaucugcaagcggaaggggauccgcaaaaagaaaguguccgccaagacuacgcagcucgaccugcugaaugaguccucccagaccauauucucccucgacauggagugcaagcaacugcuguuugaggagcucaaccugaagggcgaucugaaguccgacaaggugcugaagcugcugggauacagcccccaagagugggagaucaacuacaaccaacucgagggcaaucggacccagaaggcccucuacgaggcguaccugaagaucgucgagauggaggcccacgacgugaaggacauccuccagaucaagagcgccaaggacgauuggucccucgaugagagcccucuguccgccucugagauccgcgaguccgugaaggccaucuuccaggcgcuggggaucugcacgaaaaucuuauauuucgacccccugcugccggucaaggaguucgagaagcaggacagcuaccagcucuggcaccuccuguacagcuacgagagugaugacagcacguccggcaacgagacccuauaucggauacuggagaagaaguacgccuuuaaacgcgagcaugugcggauccuggccaacguggcccuccaggaugacuacggcagucuguccaccaaggcgauccgcaagaucuaccccaacaucaaggagaaccaguacagcauagcaugcgagauggccggguacaagcacucgaagcugagccugaccacggaggagcuggaggcccgcgagcugaagaacaucaucccucuccugaagaagaacgcccugcgcaaccccgucguggagaagauccucaaccagaugaucaacgucgugaacgcgcugauagagaagaacucggagcgugacgcagagggcaagaucaccaaguacuuucacuucgacgagauccgcaucgaacuggcccgggagcucaaaaagaacgcccagaagcguuacgagaugacccagaacaucaacaaggccaagcuggagcaccagaagaucagcgagauccugcagaagcaauucgggaucaagaauccaaccaaguccgacaucauccgguaucgccuauaucaggagcuggagcacaacggcuacaaggagcuguacacgaacgcguacaucgcucccgacguguuauucagcaagaacaucgacaucgaacacaucguccccaaggcccguguguucgacgacuccuucaguaacaagacccuagccuuccgggaguucaacaucaagaagggugagucgaccgccuucgauuacaucaccucucugaacuccgaggaggagcucaaccaguaccugacccggguggagaacgcguauaagaccaagucgaucucgcccaccaaguacaaaaaccugcucaagaaggcauccgagaucggcgaugacuucaucaacagagaccugcgcgacacccaguacaucgcgaagaaggcuaaggagauccuguuccagguaaccaaaaacguccugagcacguccggcagcaucaccgaccgacugcgugaggacugggggcugguggacguaaugaaggagcucaacaugccgaaguaucagucccucggccugaccgagguggaggagcggaaggacgggaacaaggugacggucaucaagaacuggacgaagcgcaacgaccaccggcaccacgcaauggacgcccucaccguagccuucaccaaacccagcuacauacaguaccugaaucaccugaacgcccgcaaggacgagaacaacaagaacuacuccgugauccucgccaucgaggagaaggagacgaucaagguccggacgaacaacggcaagaacaagcgcguguucaucgagcccauacccaacuuccgccagguugcgaagaagcaccuggaggagaucuucaucagccacaagaccaagaacaaggucgugaccaagaacgucaacaaaccggccgggaccgacaagcagcagaucacccugacgccccggggacagcuccacaaggagaccauauacgguaaguaccaguauuacgucaacaaggaggagaagaucggugugaaguucgacaaggagacaaucgccaaaguguccaacccgcuguaccgggaggcucuacucaagagacuccaggccaacgauaacgaccccaagaaagcguucacgggcaagaacgcccugagcaagaagccgaucuaccucgacgaguccaagaccaagacccuacccgaaaaagucaaccugacauaccucgaggaggacuucagcauccggaaagacaucucccccgacaacuucaaggaccuaaagagcaucgagaaggugaucgaccaaggggugaagcgcaucuugaucaagcgguuacaagcauacgacaacgaccccaaaaaggcguucgucgaccuagagaagaacccgaucuggcugaacaaagagaagggcaucgccaucaagagaguuacgaucuccggcgugaacaaugcgcagccccuccacauugguaaggaccaccugggcaagaccacccugaacaaggaggggaaggagaucccggucgacuaugugagcaccggaaacaaccaccacguggccaucuaccgggacaaggaggggaaccuccaggagcagaucgucuccuucuucgaugcagugguacgagcccagcagggccugccgauuaucgacaagacguacaagcaggcggagggcuggcaauucauguuuaccaugaagcagaaugaaauguucgucuucccgaaugaaacuaccgguuucaaccccgcagaaaucgaccugcucgaccccaagaacaagaaacugaucagcccgaaccuguuccgggugcagacgaucuccguggucaaguacggcaacagcguggugcgcgacuucaaguuccggcaccaccuagagaccaccuugcaggacgacaagauccugcaggggaucaccuuccagcagauaaaaagucucgagcccuuacgcaacaucgucaaggugcgcaucaaccaccugggcgacaucguguccaucggcgaguacuga

SEQ ID NO: 7997 - RNA, 4308 nt, Artificial Sequence
  Cas9 variant
augaagaacauacugggccucgaccuggggaccaccagcaucggcuucgcccacaucguggaggacgagaacaaggagaaguccgagaucaaggagcuggggguacgcaucgugagccucgccacggacgagcagagcgacuucgagaaggguaagagcaucuccaccaacgcuaaccggacacugaaacacggggcccgccugaaccucgaccgguaccagcagcggcggaaguuccugaucgaccugcuacagaaggccaaccugaucaccagcgccuccauccuggccgagaauggcaagaacacgacccacagcaccuggcagcuccgcgcgaaggcagugaccgaacgcaucgagaaggaggaguucgcccgcgugcugcuggcgaucaacaagaagcggggcuauaagaacucccgcaagacgaagaccgaggacgaggggcaggcgaucgacggcauggccaucgcuaagugccuauacgacgagaaccucacccccgggcagcugagccuccagcugcugcaacagaacaagaagcuccugccggacuucuaccgguccgaccugcagaaggaguuugaucugguguggaaccugcagaagcaauuuuaccccgacauccugaccgacagcuucuacaaggagcuccagggcaaggggaaggacgcgacgucaaaggccuucagcaagcgcuaccacuucgacaccgcugagaauaagggcuccaaggagagcgugcgccugcaggccuaccaguggcgcgccgaggccaucucuaagcagcugagcaaggaggaggucgccuacgugcucaccgagaucaacaauaaccugaacaacuccucggguuaccugggggcgaucagcgaccgguccaaagagcucuacuucaaucgccagaccgugggccaguaccuguacgcccaacugcaggagaacaggcacaacagccucaagaacaagguuuucuaccgccaggacuaccuggacgaguucgaacggaucugggagacucaggccuccuuccacaaggaguuaaccgacgaacuaaagaagcagauccgagacgugguuaucuucuaccagcggaagcuaaagagccagaaggggcuggucuccuucugcgaguucgagagcaaggagaucgagaucgagaaggauggcaaggccauaaccaaguccauuggugcccgcguggugcccaagagcagcccccucuuccaggaguucaagaucuggcagauccugaacaacgucacgugcaagcgaaaggggauccggaagaagaaguccuccgccaagucgacggagcuggaccucuucaacgagccgucccagagcaucuuuucccuggacauggagugcaagcagcuccuguucgacgagcugaaccugaagggcgaccucaagagcgacaaggugcugaagcugcugggguacagcccacaggagugggagauaaacuacaaccagcucgagggcaaccgcacccagaagucccuguacgaggcguaccugaagaucaucgagaucgagggcuacgaggugaaggacauccuccagaucaaaucuaccaaggacgacuggagccuggacgagagcccccuguccgccagcgagauccgggagagagucaaggugauuuuccagacccugggcaucugcacgaagauccuguacuucgauccucugcucccggugaaggaguucgagcagcaguacuccuaccaacuguggcaccuccuguacagcuacgaguccgacgacagcaccucgggcaacgagacccuguaccggauccuggaaaagaaguacgccuucaagcgcgagcacgccaccaucuuagcgaacguggcccugcaggacgacuacgggagccuguccacgaaggccaucagaaagaucuaccccuacaucaaggagaaccaguauagcaccgccugcgagcucgcgggcuacaagcacuccaagcugucgcugaccaccgaggagcucgaggcccgcgagcugaagaacaucaucccccugcucaagaagaacgccuuacggaaccccgugguggagaagauccugaaccaaaugaucaacgucgugaacgcccucaucgagaaaaauuccgagcgcgacgccgagggcaagaucacgaaguacuuccacuuugacgagauccggaucgagcuggcgcgcgagcugaagaaaaacgcccaggagcgauacgagaugacccagaacaucaacaaggccaagcucgagcaccagaagaucagcgaaaagcugcagaagcaguucggcaucaagaauccgacuaaguccgacaucauccgcuaccgguuauaccaggagcucgagcacaauggauauaaggagcuguacaccaacacguacaucgcccccgacguccuauucagcaagaacaucgacaucgagcacaucgugccgaaggcacguguguucgacgacuccuucagcaauaagacccucgcguucaaggaguucaacaucaagaagggcgagagcaccgccuucgacuauaucaccucgcugaacugcgagggcgaguugaaccaguaccucacccgggucgagaacgccuacaagaccaagagcaucucccugaccaaguacaagaaucugcucaagaaagccagcgagaucggggacggcuucaucaaccgcgaucugcgggacacccaguacaucgccaagaaggcuaaggagauccuguuccaggugaccaagaacgugcucuccacgaguggguccaucacagaccgucugcgcgaggacuggggccuggucgacgucaugaaggagcucaacaugcccaaguaccagagccuggggcugaccgagguggaggagcggaaggacgggaacaaggucaccgugaucaaagacuggacgaagaggaacgaccaccggcaccaugccauggacgcccucaccguggccuucaccaaaccguccuacauccaguaccugaaccaccugaacgcgcgcaaggacgagaacaacaagaacuacagcgucauccucgccaucgagaagaaggagaccaucaagguccccauuaacaacggcaagaacaagcggguguucaucgagcccauccugaacuuccgccaggucgcuaagaagcaccuggaagagaucuucaucagccacaaggccaagaauaagguggugacaaagaacauaaauaagcccgccgggaccgacaaacagcagaucacccucaccccgcggggccagcuacacaaggagacgaucuacgggaaguaccaguacuacgucaacaaggaggagaaggugggcgugaaguucgacgagcgcacuaucaccaaggucagcaacccacuguaccgggaggcgcuccugaagagacugcaggccaacgacaacgaccccaagaaggccuucgccggcaaaaacgcccucuccaagaaccccaucuaccuggacgaggcgaagaccaaaacgcucccggagaaggugaaccuaaccuaccuggaggaagacuuuucaauccgcaaggauaucucccccgacaacuucaaggaucucaagagcauagagaagguaauagaccagggggucaagcgcauccugaucaagcggcugcaggccuacgacaacgaccccaagaaagccuucguggacuuagaaaagaaccccaucuggcucaacaaggagaaggguaucgccauuaagcgcgugaccaucuccgggguuagcaacgcccagccgcugcacaucggcaaagaccacuuagggaagaccacgcucaacaaggagggcaaggagguucccguggacuaugucucaaccggcaacaaccaccacguggcgaucuaccgggacaaggaggggaacuuacaggagcaaaucgugagcuucuucgaggccgucgugcgcgcccagcagggccugcccaucaucgacaagaauuacaagcaggccgagggguggcaauucauguucacgaugaagcaaaacgagauguucguauucccgaacgaggcgacaggguucaaccccgccgagaucgaccuccuggauccuaagaauaagaagcugauaagcccuaaccucuuccggguccagacgaucuccaucgugaaguacgggaacagcgugguccgcgacuucaaguuccggcaccaccuggagaccacccugcaggacgacaagauccuccagggcaucaccuuccagcagaucaagucucuggagccgcugcgcaacaucgugaaggugcggaucaaccaccucggcgacaucgucaacaucggggaguacuga

SEQ ID NO: 7998 - RNA, 4311 nt, Artificial Sequence; identical to SEQ ID NO: 2198
  Cas9 variant

SEQ ID NO: 7999 - RNA, 4311 nt, Artificial Sequence; identical to SEQ ID NO: 2199
  Cas9 variant

SEQ ID NO: 8000 - RNA, 4311 nt, Artificial Sequence
  Cas9 variant
augaagcgcauccugggccucgaccucgguaccaacagcaucggcugggcccuggugaacgaggccgagaacaaggacgagcgguccagcaucgucaagcucgggguucgcgugaacccccugaccgucgacgagcugacgaacuucgagaagggcaaguccauaaccaccaacgcggacaggacccucaagcgcgggaugcggcgcaaucugcagcgguacaagcugcgccgggagacgcucaccgaggugcuuaaggagcacaagcugaucaccgaggauaccauccucagcgagaacggcaaccgcacaaccuucgagaccuaccggcuacgcgccaaggccgugaccgaggagaucucccuggaggaguucgcccggguccuccugaugaucaacaagaagcgcggcuacaagagcucccggaaggccaaggggguggaagagggcacgcugaucgacgggauggacaucgcgcgcgagcucuacaacaacaaccugacgccgggcgagcugugccuccagcugcuggacgccgggaaaaaguuccuccccgacuucuaccggagcgaccugcagaacgagcuggaccgcaucugggagaagcagaaggaguacuaccccgagauccucaccgaugugcugaaggaggaacugcgggguaagaagcgcgacgccgucugggccaucugcgcgaaguacuucguguggaaggagaacuacaccgaguggaacaaagagaagggcaagacggagcagcaggagcgggagcacaagcucgaggggaucuacuccaagcgcaagcgggacgaggccaagcgagagaaccugcaguggagagugaacggccugaaggagaagcucagccuggagcagcuggucaucguguuccaggagaugaacacccagaucaacaacuccagcggguaccucggcgcuaucuccgaccggagcaaggagcuguacuucaacaagcagacggucggccaguaccagauggagaugcuggauaagaaccccaacgccucccuccgcaacauggucuucuaccggcaggacuaccuggacgaguucaacaugcugugggagaagcaggccguguaccacaaggagcucaccgaggagcugaagaaggagauccgcgacaucaucaucuucuaccagcggcgccucaagagccaaaagggucugaucggcuucugcgaguucgagucccggcagaucgagguggacaucgacgggaagaagaagaucaagacggucggcaaccgcgugaucagccgguccagcccgcuguuccaggaguucaagaucuggcagauacugaacaacaucgaggugaccgucguggggaagaagcgcaagcggcgcaagcucaaggagaacuacagcgcucuguucgaggagcugaacgacgccgagcagcuggaacucaacggcucccggcgccugugccaggaggagaaggagcugcucgcccaggagcuguucauccgggacaagaugaccaagagcgaggugcugaagcuccuguucgacaauccccaggagcuggaccucaacuucaagaccaucgacggcaacaagacgggguacgcucuguuccaggccuacuccaagaugaucgagaugagcggccacgagcccgucgauuucaagaagcccguggaaaaggucguggaguacaucaaggcgguguucgaccugcucaacuggaacaccgacauccugggguucaacuccaacgaggagcuggacaaccagucauacuacaagcucuggcaccuccuguacuccuucgagggcgacaacaccccgacugggaacggccgccugauccagaagaugacggagcuguauggcuucgagaaggaguacgccaccauccuggcgaacgucagcuuccaggacgacuacgggucccucucagccaaggccauacacaagauccugccccaccugaaggagggcaaccgguacgacguggcgugcguuuacgccggguaccgccacuccgagagcucccugacccgcgaggagaucgccaacaagguccucaaggaccggcugaugcuccugcccaagaacagccugcacaaccccguggucgagaagauccuaaaccagauggucaacgugaucaacgugaucaucgacauauacggcaagccggacgagauccgcgucgagcuggcccgggagcugaagaagaacgccaaggagagagaggagcucaccaaguccaucgcgcagacgaccaaggcccacgaggaguacaagacccugcugcagaccgaguucgggcucacgaacgugagccggaccgacauccugcgcuacaaacuguacaaggagcucgaguccugcggcuacaaaacacuguauagcaacaccuacaucucccgggagaagcuguucagcaaggaguucgacaucgagcacaucaucccccaggccaggcucuuugacgauagcuucuccaacaagacccuggaggcacggagcgugaacaucgagaagggcaacaagacggcguaugacuucgucaaggagaaguucggggagucaggcgccgacaacagccuggagcacuaucucaauaacaucgaggaucuguucaaguccgggaagaucagcaagaccaaguacaacaagcugaagauggccgagcaggacauccccgacggcuucaucgagcgcgaccuccggaacacccaguacaucgccaagaaggcccuguccaugcugaacgagaucagccaccgcguggucgcgaccuccggcagcgucacggacaaacuccgggaggacuggcaguugaucgaugugaugaaggagcugaacugggagaaguacaaggcccucggccugguggaguacuucgaggaccgcgacggcaggcagaucgggcgaaucaaggacuggaccaagcggaacgaccaccgccaccacgccauggacgcccugaccgucgccuucacuaaggacguguucauccaguacuucaauaacaaaaacgcgucccucgaccccaacgccaaugagcacgccaucaagaacaaguacuuccagaacggccgggccaucgccccuaugccccugcgcgaguuccgggcggaagccaagaagcaccuggagaacacgcucaucagcaucaaggccaagaacaaggugaucaccgggaacaucaacaagacccgcaagaagggcggcgucaacaaaaacaugcagcagacgccccgcgggcaacugcaccuggagaccaucuacggcuccgggaaacaguaucucaccaaggaggagaaggugaacgccagcuucgacaugcggaagaucggcaccguguccaagcuggcguaccgcgaugcccugcucaagcggcuguacgagaacgauaacgaccccaagaaggccuucgccggcaagaacagccuggacaagcagccgaucuggcucgacaaggagcagaugcgcaagguccccgagaaggugaagaucgugacccuggaggccaucuacacgauucggaaggagaucagucccgaccugaagguggacaaggugaucgacgugggcguccgcaagauccucaucgaccggcugaacgaguacgguaacgacgcgaagaaggccuucagcaaccuugacgaaaaccccaucuggcucaacaaggagaaggggauaagcaucaaacgcgugaccaucuccggcaucagcaacgcccagucccugcacgugaagaaggacaaggacgggaagccgauccuggacgagaacggccguaacauccccgucgacuuugugaacaccgggaacaaccaccacguggccgucuacuaccgccccgugaucgacaagcggggccagcucguggucgacgaggccggcaaccccaaguacgagcuggaggaggugguugucagcuucuucgaggcggugacccgcgccaaucuggggcagccgaucaucgacaaggacuacaagacgaccgagggcuggcaauuccucuucuccaugaagcagaacgaguacuucguguuccccaacgagaagaccggguucaaccccaaggagaucgaccugcuggaugucgagaacuacggccucaucagcccgaaccuguuccgggugcagaaguuuucccugaagaacuacguguuccgccaccaccucgagaccacgaucaaagacaccagcuccauccugcgggggaucacuuggauagacuuucggucuuccaagggccuggacaccaucgucaaggugcgcguuaaccacauuggccagaucgugagcgugggcgaguacuga

SEQ ID NO: 8001 - RNA, 4311 nt, Artificial Sequence
  Cas9 variant
augaagcgcauccugggcuuggaucuggggacaaacaguaucggcugggcccuggugaacgaggccgagaacaaggacgagcggucgagcaucgucaagcucggggugcgcgugaacccccugaccguggacgaacugacgaacuucgagaagggcaaauccauuaccaccaacgcggaccggacccucaagcgcgggaugcggcguaaccugcagcgguacaagcugcgccgggagacgcucacugagguacugaaggagcacaagcugaucacggaggauacgauccucagcgagaacggcaaccgcacgaccuuugaaaccuaccggcuucgcgccaaggccgugaccgaggagaucucccuggaggaguucgcccggguccuccugaugaucaauaagaagcgcggauacaagagcucccggaaggccaaggggguggaggagggcacgcugaucgacgggauggacauagcgcgcgagcucuacaacaacaaccugaccccuggcgagcugugccuccagcugcuggacgccgggaagaaguuccuccccgacuucuaccgcuccgacuugcagaacgaacuggaccgcaucugggaaaagcagaaggaguacuaucccgagauccuaaccgacguguugaaggaggagcugcggggcaagaagcgcgacgccgucugggccaucugcgcgaaguacuucguguggaaggagaccuacacggaguggaacaaggagaagggcaagaccgagcagcaggagcgggagcacaagcucgaggggaucuacuccaagcgcaagcgcgacgaggccaagcgggagaaccugcaguggcgggugaacggccugaaggaaaaacuuucccuggagcagcuggucaucguguuccaggagaugaacacccagaucaacaacuccagcggguaccucggcgccaucuccgaccggagcaaggagcuguacuucaacaagcagaccgugggccaguaccagauggagaugcuggacaagaaccccaacgccucccuccgcaacaugguguucuaccggcaggacuaccuggacgaguucaacaugcugugggagaagcaggccguuuaucacaaggagcucacggaggaacugaagaaggagauucgcgacaucaucauauuuuaccagcggcgccuaaagagccagaaggggcucaucggauucugcgaguucgagucccgccagaucgagguggacaucgacgggaagaagaagaucaagaccgucggaaaucgcgugaucagccgguccagcccgcuguuccaggaguucaagaucuggcagauccugaacaacaucgaggugaccgucguggggaagaaacgcaagcggcgcaagcucaaggagaauuacagcgcgaucuucgaggagcugaacgacgcagagcagcuggagcugaacggcagcagacgccucugccaggaggagaaggagcugcuggcacaagaacuguucgugcgggacaagaugaccaagagcgagguccugaaacuccuguucgacaacccgcaggagcuggaccugaacuucaagaccaucgacggcaacaagaccggguacgcccucuuccaggccuauuccaagaugaucgagaugagcggacacgagcccguggacuucaagaagcccgucgagaaggugguggaguacaucaaggcggucuucgaccugcuuaacuggaacaccgacauccucggguucaacucgaacgaagaacuagacaaccagagcuacuacaagcuguggcaccuccuguacucauucgagggcgacaacaccccgacggggaacggccgccugauccagaagaugaccgagcucuacggcuucgagaaggaguaugccaccauacuggccaacgugucguuccaggacgacuacggaucccugagcgccaaggccauccacaagauccucccccaucugaaagagggcaaccgguacgacguggcgugcgucuacgccggguaccgccacuccgagagcucccugaccagggaggagaucgccaacaaagugcucaaggaccggcugaugcugcuccccaagaacagccugcacaaccccguggucgagaagauccugaaccagauggugaacgugaucaacgucaucaucgacaucuacggcaagccggacgagauccgcguggagcucgccagagagcugaagaaaaacgccaaggagcgcgaggagcugacgaaauccaucgcgcagaccaccaaggccaacgaggaguacaagacccuccugcagacggaguucgggcucaccaacgugagccggacggacauccuccgcuacaagcuguacaaggagcuggaguccugcggcuacaagaccuuguacagcaacaccuacaucucccgggagaagcuguucagcaaggaguucgauaucgagcacaucaucccccaggcacgccuguucgacgacagcuucuccaacaaaacgcucgaggcccggagcgucaacaucgaaaagggcaacaagacugcguacgacuucgugaaggagaaguuuggggaguccggcgccgacaacagccuggagcacuaccugaacaacaucgaggaccuauucaaguccgggaagaucagcaagaccaaguacaauaagcugaagauggccaagcaggacauccccgacggcuuuaucgagcgcgaccugcggaacacucaguacaucgccaagaaggcccucuccaugcugaacgagaucagccaccgcguggucgcgacguccggcagcgugaccgacaagcugagggaagacuggcagcucaucgacgugaugaaggagcugaacugggagaaauacaaggcccuggggcucgucgaguacuucgaagaccgcgacggccggcagaucgggcgcaucaaggacuggaccaagcggaacgaccaccgccaccacgcuauggacgcccugacgguggccuucacgaaggacguguucauccaguacuucaacaacaaaaacgccucccuggaccccaacgccaacgagcacgccaucaaaaacaaguacuuccaaaauggcagggccauugccccgaugccccuccgagaguuccgggcggaagcaaagaagcaccuggagaacacccucaucagcaucaaggcgaagaauaaggucauaaccgggaacaucaacaagacacggaagaagggcggggugaacaagaacaugcagcagacgccccgagggcagcuccaccuggagaccaucuacggcuccgggaagcaguaccugaccaaggaggagcgggugaacgcgucauucgacaugcgcaaaaucgaaacugucuccaagagcgcuuaccgggacgcccuccugaagcgccuguacgagaacgacaacgacccaaagaaggccuucgccggcaagaacucccucgacaaacagccgauauggcuugacaaggagcagaagcggaaggugcccgagaaggugaaaaucgucacgcuggaggccaucuacaccauccgcaaggagaucagccccgaccucaagguggacaaggugaucgacgucggggugcggaagauccugaucgaccgccuaaacgaguacgggaacgacgcgaagaaggccuucagcaaucucgacgagaaccccaucuggcugaacaaagagaaggggaucuccaucaagcgagugacgaucagcgggauauccaacgcccagagccugcacgucaagaaggacaaggacggcaagccgauccucgacgagaacgggcgcaacauccccguggacuucgugaacaccggcaacaaccaccacgucgccguguacuacaggccagugaucgacaagcgcgggcagcuggucguggacgaggccggcaaccccaaguacgagcuggaggaaguggucguguccuucuucgaggcggugacccgggccaaccucggccagccgaucaucgauaaggacuacaagaccacagagggguggcaguuccuguucucaaugaagcagaacgaguauuucgucuucccuaacgagaagaccggcuucaaccccaaggagaucgaccuguuggacguggagaacuacgggcugauuagcccgaaccuguucagagugcagaaguucucguuaaagaacuaugucuuccggcaccaccuggagacgaccaucaaggauaccuccucgauccugcgcggaaucaccuggaucgacuucagauccagcaaggggcucgacacgaucgugaagguccgcgugaaccacaucggccagaucguguccguuggcgaguacuga

SEQ ID NO: 8002 - RNA, 4311 nt, Artificial Sequence
  Cas9 variant
augaagcgcauccugggccucgaucuggggaccaacagcaucggcugggcccuggugaacgaggcagagaacaaagacgagcgguccagcaucgucaagcucggggugcgcgugaacccccuuaccgucgacgagcugacuaauuucgagaagggcaagucgaucaccaccaacgcggaccggacccuaaagcgcgggaugcggcgcaaccugcagcgguacaagcugcgccgggagacgcucaccgagguacugaaagagcacaagcugaucaccgaggacaccauccucagcgagaauggaaaccgcacgaccuucgagacauaccggcugcgugccaaggccguuaccgaggagaucuccuuagaggaguucgcgcggguccuccugaugaucaacaagaaacgcggcuacaaaagcucccggaaggccaaggggguggaggagggcacacugaucgacgggauggacaucgcgcgcgagcucuacaacaacaaccugaccccgggcgagcugugccuccagcugcuggacgccgggaagaaguuccuccccgacuucuaccggagcgaucugcagaacgagcuggacaggaucugggagaagcagaaggaguacuaccccgaaauccucaccgacgugcugaaggaggagcugcggggcaagaagcgcgacgccgucugggcgaucugcgccaaguacuucguguggaaggagacauacacggaguggaacaaggagaaagggaagaccgagcagcaggagaaggagcacaagcucgaggggaucuacuccaagcggaagcgcgacgaggccaagcgcgagaaccugcaguggcgggugaacggccugaaggagaagcucagccuugagcagcuggucaucgucuuccaggagaugaacacgcagaucaacaacuccagcggcuaccucggcgccaucuccgaccgcagcaaggagcuguacuuuaacaagcagaccgugggccaauaccagauggagaugcuggacaagaaccccaacgccucccuccggaacauggucuuuuaccgccaggacuaccuggacgaguucaacaugcugugggagaagcaggccguguaccacaaggagcucacggaggagcugaagaaagagaucagagacaucauaauuuucuaccagcgccggcucaaaagccaaaaggggcucaucggcuucugcgaguucgagucccgccagaucgagguggacaucgacgggaaaaagaagaucaagaccgucggcaacagggugaucagcagauccagcccgcuguuucaggaguucaaaaucuggcagauucugaacaacaucgaggugaccgucguggggaagaagcgcaagcgccgaaagcucaaggagaacuauucagcgcuuuucgaggagcugaacgacgccgagcagcuggagcuaaacggcucccgccggcugugccaggaggagaaagagcugcucgcccaggagcuguucauccgugacaagaugacuaagagcgaggugcugaagcuccuguucgacaacccccaggaacuggaccucaacuucaagacgaucgacggcaacaagaccggguacgcacuguuccaggccuacuccaagaugauagagaugagcggccacgagcccguagacuucaagaaacccguggagaaggucguggaguacaucaaagcgguguucgaccugcucaacuggaacaccgacauccugggguucaauagcaacgaggaacuggacaaccagagcuacuacaagcucuggcaccuccuguacuccuucgagggcgacaacaccccgacggggaacggucggcugauccagaagaugaccgagcuauacggcuucgagaaggaguacgccaccauucuggccaacgucagcuuccaggacgacuacgggucucucagcgccaaggccauccacaagauccugccacaccugaaggagggcaaccgcuacgacguggcuugcguguacgcaggcuaccggcacuccgagagcucccucacccgcgaggagaucgccaacaaaguccugaaggaccgccugaugcuccugcccaagaacagccugcacaaccccgugguggagaagauccucaaccagauggucaacgugaucaacgugaucaucgacauuuacggcaagccggacgaaauccgggucgagcuggcccgcgagcugaagaagaacgccaaggagcgggaggagcucacgaaguccaucgcgcagaccaccaaggcccacgaggaguacaagacccugcugcagacggaguucgggcucaccaacgugagccgcaccgacaucuuacgguacaagcuguacaaggagcucgaguccugcggauauaagacccuguacagcaauaccuacaucaguagagagaagcuauucagcaaggaguucgauauagagcacaucaucccccaggcccggcuguucgacgacagcuucuccaauaagacacuggaagcacgcagcgugaacaucgagaaaggcaacaaaaccgcguacgauuucgucaaggagaaguucggggaguccggcgccgacaacagccuggagcauuaccucaacaacaucgaggaccuguucaaguccgggaagaucagcaagaccaaguacaacaagcugaagauggccgagcaggacauccccgacggcuucaucgagcgggaccuacgcaacacccaauacauugccaagaaagcccuguccaugcugaacgagaucucgcaccgggugguggcgacguccggcagcgucaccgacaagcuccgcgaagacuggcagcugaucgacgugaugaaggagcugaacugggagaaguacaaggcccuggggcugguggaguacuucgaggaccgggauggccgccagaucgggcggaucaaggauuggacuaaacgcaacgaccaccggcaccacgccauggacgcccugacggucgccuuuacgaaggacguguucauccaguacuucaacaacaagaacgcguccuuggaccccaacgccaacgagcacgccauaaagaacaaguacuuucagaacggcagagccauagccccgaugccccuccgggaguuccgcgcggaggccaagaagcaccuggagaacacccucaucaguaucaaggcuaagaacaaggugaucaccgggaacaucaacaagacccggaagaagggcggcgucaacaagaacaugcagcagacgcccagagggcagcugcaccuggagaccaucuacggcuccgggaaacaguaccucaccaaggaggagaaggugaacgccagcuucgauaugcgcaagaucggcaccgucuccaagcuggcguacagggacgcccugcucaagcgccuguacgagaacgauaacgaccccaagaaggccuucgccgggaagaacucacuggacaagcagccgaucuggcucgacaaggagcagaugcggaagguucccgagaaggugaaaaucgugacgcuggaagccaucuacaccauccgcaaggagaucucacccgaccugaaggucgacaaagugaucgacgugggcguccggaagauccucaucgaccgccuaaacgaguacggcaacgacgcgaagaaggccuucagcaaccuggacgagaaccccaucuggcucaacaaggaaaaggggaucagcaucaagcgagugaccaucuccggcaucagcaacgcccagucccugcacguuaagaaggacaaggacgggaagccgauccuggacgagaacgggcgaaacauccccgucgacuucgugaacaccgggaacaaccaccacguggccgucuauuaccggcccgugaucgacaagcgcggccaguuaguggucgacgaggcaggcaauccaaaguacgagcuggaggaggugguggucagcuucuucgaggcggugacgagagccaaccuggggcagccgaucaucgacaaggacuacaagaccaccgaaggcuggcaguuccucuucuccaugaagcagaacgaguacuucguguuccccaacgagaagaccggguucaaucccaaggagaucgaccugcuggacgucgagaacuacggccucaucagcccgaaccuauucagggugcagaaguucagccugaaaaacuacguguuccggcaccaccucgagacgaccaucaaggauacuagcucuauccugcgcggaaucaccuggaucgacuuccggagcuccaagggccuggacacgaucgugaaggugcgcgucaaccacaucggccagaucgugagcguaggugaguacuga

SEQ ID NO: 8003 - RNA, 4311 nt, Artificial Sequence
  Cas9 variant
augaagcgcauccugggccucgaccuggggaccaacagcauaggcugggcccuggugaacgaggccgagaacaaggacgagcgguccagcaucgucaagcucgggguucgcgugaacccccugaccguagacgagcugacgaacuucgagaagggcaaguccaucaccaccaacgcggaccggacccucaagcgcgggaugcggcgcaaccugcaacgguacaagcugcgccgggagacgcucaccgaggugcugaaggagcacaagcugaucaccgaggacaccauccucagcgagaauggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcucgcgagcucuacaacaacaaccugaccccuggcgagcugugucuccagcugcuggacgccgggaagaaguuccuccccgacuucuaccggagcgaccugcagaacgagcuggaccgcaucugggagaagcagaaggaguauuaucccgagaucuuaaccgacguguugaaggaggagcugcggggcaagaagcgcgacgccgugugggccaucugcgcgaaguacuucguguggaaggagaacuacaccgaguggaacaaggagaagggcaagacggagcagcaggagagagagcacaagcucgaggggaucuacuccaagcgcaagcgcgacgaggccaagcgggagaaccugcaguggcgcgugaacggccugaaggagaagcucagccuggagcagcuggucaucguguuccaggaaaugaacacccagaucaacaacuccagcggguaccucggcgccaucuccgaccggagcaaggagcuguacuucaacaagcagaccgugggccaguaccagauggagauguuagacaagaaccccaacgccucccuccgcaacauggucuucuacaggcaggacuaccuggacgaguuuaacaugcugugggagaagcaggccguguaccacaaggagcucaccgaggagcugaagaaggagauccgcgacaucaucaucuucuaccagaggcgccucaagagccaaaaggggcugaucggcuucugcgaguucgagucccggcagaucgagguggacaucgacgggaagaagaaaaucaagacggucggcaaccgggugaucagccguuccagcccgcuguuccaggaguucaagaucuggcagauccugaacaacauagaggugaccgucguggguaagaagcgcaagcggcgcaaacuuaaggagaacuacuccgcgcuguucgaggagcugaacgacgccgagcagcuggagcucaacgggucccggcgccugugccaggaggaaaaggagcugcucgcccaagagcuguucaucagagauaagaugaccaagagcgaggugcugaagcuccuguucgacaacccccaggagcuggaccucaacuucaagaccaucgacggcaacaagacgggguacgcccuguuccaggccuacucuaagaugaucgagaugucgggccacgagcccgucgacuucaagaagcccguggagaaggucguggaguacaucaaggcgguguucgaccugcucaacuggaauaccgacauccugggcuucaacuccaacgaggagcuggacaaccagccauacuacaagcucuggcaccuccuguacagcuucgagggcgacaacacacccaccgggaacggccgccugauccagaagaugacggagcuguacggcuucgagaaggaguacgccaccauccuggccaacgucuccuuccaggacgacuacggaagccucuccgccaaggccauccacaaaauccugccacaccugaaggagggcaaccgguacgacguggcgugcguguacgccggguaccgccacagcgaguccagccucacccgcgaggagaucgccaacaaaguccugaaggacaggcugaugcuccugcccaagaacucccugcacaacccggugguggaaaagauccucaaccagauggucaaugucaucaacgugaucaucgacaucuacggcaagcccgacgagauccgcgucgagcuggcccgggagcugaagaagaacgccaaggagcgcgaggagcucaccaagagcaucgcacagacgaccaaggcccacgaggaguacaagacccugcugcagaccgaguucgggcucacgaacgugucccggaccgacauccugcgcuacaagcuguacaaggagcucgagagcugcggcuacaagacccuguacuccaacaccuacaucagccgggagaagcuguucuccaaagaguucgacaucgagcacaucaucccccaggcccgccucuucgacgacagcuuuagcaacaagacccuggaggcccgguccgugaacaucgagaagggcaacaagacggcguacgacuucgucaaggagaaguucggggagagcggcgccgacaacucccuggagcacuaccucaacaacaucgaggaccuguucaagagcgggaagaucuccaagaccaaguacaacaagcugaagauggccgaacaggacauccccgacggcuucaucgagagggaccuccggaacacccaguacaucgccaagaaggcccugagcaugcugaacgagaucucccaucgcgugguggcgaccagcggcuccgucacggacaagcuccgggaggacuggcagcugaucgacgugaugaaggagcugaacugggagaaguacaaggcgcucgggcugguggaguacuucgaggaccgcgacggccggcagaucgggcgcaucaaagacuggacuaagcggaacgaccaccgccaccacgccauggacgcccugaccgucgccuucaccaaggacguguucauucaguacuucaacaauaagaacgcgagccucgacccgaacgccaacgagcacgccaucaagaacaaguacuuccagaacggccgggccaucgccccuaugccccugcgcgaguuccgggcggaggccaagaagcaccuggagaacacgcucaucuccaucaaggccaagaacaaggugaucaccgggaacaucaacaagacccgcaagaaagggggcgucaacaagaacaugcagcagacgccccgugggcagcugcacuuggagaccaucuacggcucagggaagcaguaccucaccaaggaggagaaggugaacgccuccuucgacaugcggaagaucggcaccgugagcaaguccgcguaccgcgacgcccugcugaagaggcucuacgagaacgacaacgacccgaagaaggcauucgccgggaagaacagcuuggacaagcagcccaucuggcuggacaaggagcagaugcgcaagguccccgagaaggugaagaucgugacccucgaggccaucuacacgauccggaaggagaucuccucggaccugaaggucgacaaggugaucgacgugggcguccgcaagauccugaucgaccggcucaacgaguacggcaacgacgcgaagaaggccuucucaaaccuggacaagaaccccauuuggcugaacaaggagaaggggaucuccaucaagcgcgugaccaucagcgggaucuccaacgcacagagccuccacgugaagaaggacaaggacgggaagccgauccuggacgagaacggccggaacauccccgucgacuucgugaacacagggaacaaccaccacguggccgucuacuaccgccccgugaucgacaagcggggccagcugguggucgacgaggccgggaaccccaaguacgagcucgaggaaguggugguauccuucuucgaggcggugacccgcgccaaccuggggcugccgaucaucgacaaggacuacaagacgaccgagggcuggcaguuccucuucagcaugaagcagaacgaguacuucguguuccccaacgagaagaccggguucaaccccaaggaaaucgaccugcuggacgucgagaacuacggccucaucuccccgaaccuguuccgggugcagaaguucagccugaagaacuacguguuccgccaccaccucgagaccacgaucaaggacaccuccagcauccugcgggggaucaccuggaucgacuuccgcuccagcaagggccuggauaccauagucaaggugcgggucaaccacaucggccagaucgugagcgugggggaguacuga

SEQ ID NO: 8004 - RNA, 4311 nt, Artificial Sequence
  Cas9 variant
augaagcgcauccugggccucgaucuggggaccaacagcaucggcugggcccuggugaacgaggccgagaacaaggaugagcgguccagcaucgucaagcucggggugcgggugaacccacugaccgucgacgagcugacgaacuucgagaagggcaaguccaucaccaccaacgcggaccggacccucaagcgcgggaugcggcgcaaccugcagcgguauaagcugagacgggagacgcucaccgaggugcugaaagagcacaagcugaucaccgaggacaccauccucagcgagaacggcaaccgcacgaccuucgagaccuaccggcugcgcgccaaggccguaaccgaggagaucucccucgaggaguucgcccggguccuccugaugaucaacaagaagcgcggcuacaagagcucccggaaggccaaggggguggaggagggcacgcugaucgacgggauggacaucgcgcgcgagcucuauaacaacaaccugaccccgggcgagcugugccuccagcugcuggacgccgggaagaaguuccuaccagacuucuaccggagcgaccugcagaacgagcuggaccgcaucugggagaagcagaaggaguacuaccccgagauccucaccgacgugcugaaggaggaacugcggggcaagaagcgcgacgccgucugggccaucugcgcgaaguacuucguguggaaggagaacuacaccgaguggaacaaggagaagggcaagacggagcagcaggagcgggaacacaagcucgaggggaucuacuccaagcgcaagcgcgacgaggccaagcgggagaaccugcaauggcgcgugaacggccugaaagagaagcucagccuggagcagcuggucaucguguuccaggagaugaacacccagaucaacaacuccagcggguaccucggcgccaucuccgaccggagcaaggagcuguacuucaacaagcaaaccgugggccagugccagauggagaugcuggacaagaaccccaacgccucccuccgcaacauggucuucuaccggcaggacuaucuggacgaguucaacaugcugugggagaagcaggccguguaccacaaggagcucaccgaggagcugaagaaggagauucgcgacaucaucaucuucuaccagcggcgccucaagagccagaaggggcugaucggguucugcgaguucgagucccggcagaucgagguggacauugacgggaagaagaagaucaagacggucggcaaccgcgugaucucgcgguccucgccacuguuccaggaguucaagaucuggcaaauacugaacaacauagaggugaccgucguggggaagaagcgcaagcggcguaagcugaaggagaacuacagcgcgcuguucgaggagcugaacgacgccgagcagcuggagcuuaacggcuccagacgccugugccaggaggagaaggagcugcucgcccaggagcuguucauccgggacaagaugaccaagagcgaggugcugaagcugcuguucgacaacccccaagagcuggaccucaacuucaagaccaucgacggcaacaagacgggcuacgcccuguuccaggccuacuccaaaaugaucgagaugagcggccacgagcccgucgacuucaagaaacccguggagaaggucguggaguauaucaaggccguguucgaucugcucaacuggaacaccgacauccugggguucaacuccaacgaggagcuggacaaccagccguacuacaagcuguggcaccuccuguacagcuuugaaggcgacaacacccccaccgggaacggccgccugauccagaagaugacggagcuguacggcuucgaaaaggaguacgccaccauccuggccaacgucuccuuccaagacgacuacggaucucucuccgccaaggccauccacaagauucugccucaccugaaggagggcaaccgguacgacguggcuugcguguaugccggguaccgccacucggaguccagccucacccgcgaggagaucgccaacaagguccugaaggaccggcugaugcuccugcccaagaacucccugcacaacccggugguggagaagauccucaaucagauggucaacgugaucaacgugaucaucgacaucuacggcaagcccgacgagauccgcgucgagcuggcccgggagcugaagaagaacgccaaggagcgcgaggagcucaccaagagcaucgcgcagacgaccaaggcccacgaggaguacaagacacuccugcagaccgaguucgggcucacgaacgugucccggaccgacauccugcgcuacaagcuguacaaggagcucgagagcugcggcuacaagacccuguacuccaacaccuacaucagccgggagaagcuguucucaaaggaguucgacaucgagcacaucaucccccaggcccgccucuucgacgacagcuucagcaacaagacccuggaggcccgguccgugaacaucgagaagggcaauaagacggcguacgacuuugucaaggagaaguucggggagagcggcgccgauaacucccuggagcacuaccuaaacaacaucgaggaccuguucaagagcgggaagaucuccaagaccaaguacaacaagcugaagauggccgagcaggacauacccgacggcuucaucgagcgcgaccuccggaauacccaguacaucgccaagaaggcccugagcaugcugaaugagaucucccaccgcgugguggcgaccagcggcuccguuacggacaaacuucgggaggacuggcaacugauugacgugaugaaggagcugaacugggagaaguacaaggcccucgggcugguggaguacuucgaggaccgcgacggccggcaaaucgggcgcaucaaggacuggaccaagcggaacgaccaccgccaccacgccauggacgcccugaccgucgccuucaccaaggacguguucauccaguacuucaacaacaagaaugcgagccucgacccgaacgccaacgagcacgccaucaagaauaaguacuuccagaauggccgggcuaucgcgcccaugccccugcgcgaguuccgggcggaggccaagaagcaccucgagaacacgcucaucuccaucaaggccaagaacaaggugaucacugggaacaucaacaagacccgcaagaagggcggcgucaacaagaacaugcagcagacgccgcgcgggcagcugcaccuggagaccaucuacggcagcgggaagcaguaccucaccaaggaggagaaggugaaugccuccuucgacaugcggaagaucggcaccgugagcaaguccgcguaccgcgacgcccugcugaagcggcucuacgagaacgacaacgacccgaagaaagccuucgcagguaagaacagccuugacaagcagcccaucuggcuggacaaggagcagaugcgcaaggucccggagaaggugaagaucgugacccucgaggccaucuacacgauccggaaggaaaucucccccgaccugaaggucgacaaggugaucgacgugggcguccgcaagauccugaucgaccgguugaacgaguacggcaacgacgcgaagaaggccuucagcaaccuggacaagaacccgaucuggcuaaacaaggagaaggggaucagcaucaagcgcgugaccaucuccggcaucucgaacgcccagucccuccacgugaagaaggacaaggacgggaagccuauccuggacgagaacggccggaacauccccgucgacuucgugaacaccgggaacaaccaccacguggccgucuacuaccgacccguuaucgacaagcggggacagcuuguggucgacgaggccggcaacccgaaguacgagcucgaggaggugguggucagcuucuucgaagcggugacccgcgccaaccugggguuacccaucaucgacaaggacuacaagacgaccgagggcuggcaguuccucuucuccaugaagcagaacgaguacuucguguuccccaacgagaagaccggguucaacccgaaggagaucgaccugcuggacgucgagaacuacggccucaucagccccaaccuguuccgggugcagaaguucucccugaagaacuacguguuccgccaccaucucgagaccacgaucaaggacaccagcuccauccugcgggggaucaccuggaucgacuuccgcagcuccaagggccuggacaccaucgucaaggugcgggucaaccacaucggccaaaucguaagcgugggggaguacuga

SEQ ID NO: 8005 - RNA, 4311 nt, Artificial Sequence
  Cas9 variant
augaagcgcauccuggggcucgaucucgggaccaauagcaucggcugggcccuggugaacgaggccgagaacaaggacgagcgguccagcaucgucaagcucggggugcgcgugaacccacugacuguagacgagcucacgaacuucgagaagggcaagucaaucaccaccaacgccgaucggacccucaagcgcgggaugcggcgcaaccugcagcgguacaaacugcgcagagagacgcugacagaggugcugaaggaacacaagcugaucaccgaggacacuauccuaagcgagaacggcaaccgcacgacguuugagaccuaucggcugagagccaaagccgugaccgaggagauuucccuagaggaguucgcccgggucuuacugaugaucaauaagaagcgcggcuacaagagcucccggaaggccaaggggguggaggagggcacgcugaucgauggcauggacauugcgcgcgagcucuacaacaacaaucugacgccgggcgagcugugccuccagcuccuggacgccgggaagaaguuccuccccgacuucuaccgcagcgaucugcaaaaugagcuggaccgcaucugggaaaagcagaaggaguacuacccugagauccuaaccgacguacugaaggaggaguuacggggcaagaagcgcgacgccgucugggcaauaugcgcgaaguacuucguguggaaggagaccuacacggaguggaacaaggagaagggcaagaccgagcaacaagagcgggagcacaagcucgaggggaucuacuccaagcguaagcgcgacgaagccaaaagagagaaccugcaguggcgcguaaacggucugaaggagaagcucagucuggagcagcucgucaucgucuuccaggaaaugaacacccagaucaacaacuccagcggguaccucggcgccauuuccgaucggucuaaggagcuguacuucaacaagcagaccgugggccaauaccaaauggagaugcuggauaagaaccccaacgccucucuccgcaacauggucuucuaccggcaggacuaccuggaugaguucaacaugcugugggagaagcaggccguguaccacaaggaacucacggaggagcugaagaaagagauucgcgacaucauaaucuucuaccagcgccgccucaagucgcagaagggcuugaucggcuucugcgaguucgagucccggcagaucgagguggacaucgacgggaagaagaagauuaagaccgucggcaacagggugauaagccgcuccagcccgcuguuucaggaguucaagaucuggcagauccugaacaacaucgaggugaccgucguggggaagaagcgcaagcggcgcaaacucaaggagaacuacagcgcgaucuucgaggagcugaacgacgcggagcagcuggagcugaacggcucccggcgccucugccaggaggagaaggagcugcuugcccaagagcuguuuguucgggacaagaugaccaagagcgaaguccuaaagcuccuguucgacaauccccaagaacuggaccuaaauuuuaagacgaucgacggcaacaagaccggguacgcacucuuccaggccuacaguaagaugaucgaaaugagcgggcacgagccggucgacuuuaagaagcccgucgagaagguggucgaguacauaaaggcggucuucgaccugcugaacuggaacaccgacauccuuggguucaacuccaaugaggagcuggacaaccagagcuacuacaagcuguggcaccuccuguacuccuucgagggcgacaacaccccgacagggaacggccgccugauccagaagaugaccgagcucuacggcuucgaaaaggaguacgccaccauccuggccaacgucagcuuccaggacgacuacggguccuuaagcgcgaaggccauccacaagauccucccgcaccugaaggagggcaaucgguacgauguggcgugcgucuacgcuggguaucgccacuccgagagcucccugaccagggaggagaucgccaacaaggugcuuaaggacaggcucauguuacuccccaagaacagccugcacaaccccguggucgagaaaauacugaaccagauggugaacgugaucaacgucaucaucgacaucuauggaaagccggacgagauccgcguggagcucgcccgggagcugaagaagaacgcuaaggagcgcgaggagcugacgaaauccaucgcgcagacuaccaaggccaaugaggaauacaagacacuccugcagacggaguucgggcuuaccaacgucagccggaccgacauccuccgcuauaagcuguacaaagagcuggagucgugcggguacaaaacccucuauucgaacaccuacaucagccgggagaagcuguucagcaaggaguuugacaucgagcacaucaucccccaggcccggcuguucgacgacagcuucuccaacaagacgcucgaggcccggagcgucaacaucgaaaagggcaacaagaccgcguacgacuucgugaaggagaaguucggggaguccggcgcagauaacucgcuggagcacuaccugaacaacaucgaggaccucuucaaauccgggaagaucagcaagaccaaguacaacaagcugaagauggccgaacaggacauccccgacggcuuuaucgagagagaccugcggaauacgcaguauaucgcaaagaaggcucucucuaugcugaacgagaucagccacagaguggucgcgacguccggcagcgugacugacaagcugcgggaggacuggcagcucaucgauguaaugaaagagcugaacugggagaaguauaaggcgcuggggcucguagaguacuucgaggaucgcgacggccggcagaucgggcgcaucaaggacuggacgaagcggaacgaccaucgccaccacgccauggacgcccugaccguggccuucacgaaggacguguuuauccaguacuucaacaacaagaacgcgagccuggaccccaacgccaacgagcacgccauuaagaauaaguacuuccagaacggacgugccaucgccccgaugccccuccgcgaguuccgggcggaggccaagaagcaccuggaaaacacccugaucagcaucaaagccaagaacaaggucaucacgggaaacaucaacaagacgaggaagaagggcggcgugaacaagaacaugcagcagacgccgcgcgggcagcuccaccuggaaaccaucuacggcucugggaaacaguaccuaaccaaagaggagaagguuaacgccagcuucgacaugcguaagaucgagaccgucuccaagucggcguaccgcgacgccuuacugaagcggcuguacgagaacgacaacgaccccaagaaggcuuucgccggcaagaacucccuggacaagcagccuaucuggcuggacaaagagcagaugcguaaggugcccgagaaggugaagaucgucacgcuggaggcgaucuacaccaucaggaaggagauuagccccgaccucaagguggacaaggugaucgacgucgggguacgcaagauccugaucgaccggcugaacgaguacggcaaugacgcgaagaaggcauuuagcaaccucgacaagaaccccaucuggcugaacaaggagaagggcaucucuaucaagcgcgugaccaucagcgggaucuccaacgcccagagccugcaugucaagaaggacaaggacggcaagccgauccuggacgagaacggccggaacauccccguggacuucgucaacaccgguaacaaccaccacgucgcaguguacuaccgccccgugaucgacaagcgggggcagcuggugguagaugaggccgggaaccccaaguaugagcuggaggagguggucguguccuucuucgaagcggugacuagagccaaccucggccugccuauuauagacaaggacuacaagaccaccgagggguggcaguuccuguucagcaugaaacagaacgaguacuucgucuucccaaacgagaagaucggguuuaaccccaaggaaaucgaucugcuggacguggagaacuacggacugauuuccccgaaccucuuccggguucagaaguucagccugaagaacuacgucuucaggcaccaccuggagaccacgaucaaagacaccuccagcauccucaggggcauaaccuggaucgacuucagauccagcaaggggcuggacaccaucgucaaaguccgggugaaccacaucggucagauaguguccgucggcgaauacuga

SEQ ID NO: 8006 - RNA, 4311 nt, Artificial Sequence
  Cas9 variant
augaagcgcauccugggccucgaccuggggaccaacagcaucggcugggcccugguggacgaggccgagaacaaggacgagcgguccagcaucgucaagcucggggugcgcgugaacccccugaccgucgacgagcugacgaacuucgagaagggcaaguccaucaccaccaacgcggacaggacccucaagcgcgggaugcggcgcaaccugcagcgguacaaacugcgccgggagacgcucauggagguacugaaggagcacaagcugaucaccgaggacaccauccucagcgagaacggaaaccgcaccacguucgagaccuaccggcugcgcgccaaggcggcuaccgagaagaucucccuggaggaguucgcccggguucuacugaugaucaacaagaagcgcggcuacaagagcugccggaaggcgaagggggccgaggagggcacccugaucgacgggauggacaucgcccgcgagcucuacaacaacaaccugacgccgggcgagcugugccuccagcugcuggacgccgggaagaaguaccuccccgacuucuaccgauccgaccugcagaacgagcuggaccgcauuugggagaagcagaaagaguacuaccccgagauccucaccgagguccugaaagaggagcugcggggcaagaagcgagacgcggugugggccaucugcgccaagagcuucgugugggaggaguacuacaccgaguggaacaaggagaagggcaaaaccgagcagcaggagcgggagcacaagcucgaggggaucuacuccaagcgcaagcgcgacgaggccaagagagagaaccugcaguggcgcgucaacggccugaaggagaagcucagccuggagcagcuggugaucgugcuccaggagaugaacauccagaucaacaacuccagcggguaccugggcgccaucuccgaccggagcaaggaacuguacuucaacaagcagacgguuggccaguaccagauggagaugcucgacaagaaccccaacgcgucccugcgcaacaugguguucuaccggcaggacuaucuagacgaguucaacacccucugggaaaagcaggccgaguaccacaaggagcugaccggggagcugaagaaggagauccgcgacaucgugaucuucuaccagcggcgguuaaagagccagaagggcuugguggguuucugcgaguucgagucccggcagaucgagguggagaucgacggcaagaagaagaucaagaccguagggaaccgcgucaucccgcggagcagcccccuguuccaggaguucaagaucuggcagauccugaacaacaucgaggugacgguggucggcaagaagggcaagcgccggaagcagaaggauaacucccccacccuguucgacgggcuggacgacaccgagcagcuggagcucaacggcagccgcuaccuguaccaggaggagaaggagcugcucgcccaggagcuguucgugcgggacaagaugaccaaguccgacgugcugaagcucuuguucgacaacccccaggagcuggaccucaacuucaagacgaucgacgggaacaagaccggcuacacccuguuccaggccuacagcaagaugaucgagaugucugggcacgagccggucgacuucaagaagacgguggagaaggucguggagcacgugaaggccgucuucgaccugcucaacuggaauacggacauucugggcuucaacagcaacgaggagcuggacaaccaguccuacuacaagcucuggcaccuucucuacagcuucgagggcgacaacacccccaccgggaacgcgcgccugguccagaagauuaccgagcuguacggguucgagaaagaguacgccaucauccuggccaacgugacguuccaggacgacuacggaucccucagcgccaaggccauccacaagauacugccccaccugaaggagggcaaccgguacgacgucgcgugcgccuacgccggguauaagcacucagagagcagccucaccaaggaggagaucgccaacaaggccuuaaaggaccgccugacccuccuacccaagaacaacuuacggaacccggugguggaaaagauccucaaccagauggucaacgugaucaacgcgaucaucgacaccuacggcaagcccgacgagauccgcguggagcuggcccgcgagcugaagaagaacgccaaggagcgugaggagcucacaaaguucaucgccgagaccacccgcaagcacgaggaguucaagauacugcuccagagcgaguucggccucaccaacgucucccggaccgacauccugagauacaagcuguacaaggagcucgaaagcugcggguacaagacacuguacuccaacaccuacaucccccgggagaagcuguucagcaaggaguucgacaucgagcacaucaucccccaggcgcgccucuucgacgacuccuucagcaacaagacccuggaggcccgguccaucaaccuggagaagggcaauaagacugccuacgacuucgugaaggagaaguucggggagagcggcgccgacaacagccucgaccacuaccugaacaacaucgaggaccuguucaaguccggcaagaucagcaagacgaaguacaacaagcucaagauggccgagcaggacaucccggacggguucaucaaucgggaccugcggaacacccaauacaucgcgaagaaggcccugucuaugcucaacgaaaucagccgccggguggucgccaccuccggcaccaucacggacaagcugcgccaggacuggcaacugguggacgugaugaaggagcucaacugggagaaguacaaggcccuggggcugguugaguacuucgaggacaaggacggccggcagaucgggcgcaucaaggacuggaccaagcggaacgaccaccgccaccacgccauggacgcgcucaccguggccuucaccaaggacaucuucauccaguacuucaacaacaagaacgccagccugaacagcaacacgaacgaguacgccaucaagaacaaguacuuccagaacggccgggccaucgcgcccaucccccugcgcgaguuccggguggaggccaagaagcaccucgagaacacccugaucagcaucaaggccaagaacaaggucgugaccggcaacaucaacaagaccaagaagcgcgggggcgugaacaaguaccugcaacagacgccacgggggcaguuacaccuggagacgaucuacggcuccgggaagcaguaccugaccaaggaggagaaggucaacgcgagcuucgacaugaagaagaucgccaccguaagcaagagcgccuaccgcgacgugcuccugaagcgccugcacgagaacgacaacgacccgaagaaggccuucacgggcaagaacucccucgacaagcagcccaucuggcuggacaaggagcagacccggaagguccccgagaaggugaagaccgugacccuggagacgaucuacaccguccgcaaggagaucagccccgaccucaagguggacaaggugaucgacgccggcguccggaagauccugaccgggcgccugaacgaguacggcaacgacgccaagaaggcguucuccaaccucgacgagaacccgaucuggcugaacaaggagaaggggaucagcaucaagagagugaccaucuccggcauuagcaacgcccagagcuuacacgugaagaaggacaaggacgggaagcccauccucgacgaggauucccgcaacauccccguugacuucgugaacacgggcaacaaccaccacguggccgucuaccggcgccccgugaucgacaagcggggucaacuggugaucgacgaagccgggaacccgaaguacgagcuggaggaagucguggugagcuucuucgaggccgucacccgcgcuaaccucggccagcccaucaucgacaaggacuacaagaccuccgagggguggcaguuccuguucagcaugaagcagaaugaguauuucguguuccccaacgagaagaccggcuucaacccgaaggagaucgaccugcucgacgccgagaacuacggggugaucucccccaaccuguuccggguccagaaguucgcccacaagaacuacguguuccgccaccaccuggagacgaccaucaaggacaccagcuccauccucaagggcaucaccuggaucgacuuccggagcucaaagggccuggacgccaucgucaagguccgcgugaaccacaucggucagaucgucagcgugggcgaguacuga

SEQ ID NO: 8007 - RNA, 4311 nt, Artificial Sequence; identical to SEQ ID NO: 2207
  Cas9 variant

SEQ ID NO: 8008 - RNA, 4314 nt, Artificial Sequence
  Cas9 variant
augaaguacaucaaguacauccugggccucgacaucggcagcaacuccaucggcugggcccuaauucaacuggaccuccugcagaagaccaagcgcaucaucgccacggggagccggaucauucccauggaccagaaggugcuguccgacuucggcaaggggaucacgaucagcccuaccgcgcagcgcacguccuaccggaaugcgcgccauugccgggagcgccaccuacugcggcgcgagcggcugcaccgcguccuccacaucuuaggcuuccugcccacccacuacgacaagcagaucgacuucagcaagcgguacggcaaguuuguugacaacacggagcccaaaaucgccuacaacgagcgcaaguuccuguucauggauaguuuccaggagaugcuggccgacuucaagauccaccagcccgaccuguucuacacgaagaagaacggggaggagaguaagaucccguacgacuggaccaucuacuaccuccggaagaaggcccugucccgcaagaucagcaaagaggagcuggcguggaucauccucaacuucaaccagaagcggggcuacuaccaacugcgcgaagaggaggaggagaacaaggagaaugacuucgagaucaucuccagcaagaucaucuccgugaucaagaaggacaaagacaagaaguacaacaaguauugguacgacaucauccuggagaacgggcucgucuaccaggccgcguucuacaaugacuucguguacaauuggaucaaccaggaccgggaguucauaaucgagcgaauuagccugaagaacggcaccgagaaggugaagcuguccuaccuccccacguuugacgagaucgacaaaauggacaagaaggagcaggacaaguacuacaagaagaucaagaucaagaccgagaacucuaucgggaacaagaccgucggcugcuacauuuacgaccacauccugcagaaccccaacgagaagauuaagggcaagcuggugcggacgaucgagcgcaaguacuacaaggaggagcugaaggccauccuggagaagcagguugcgcugcagcccgagcuguucacggaccaacuguucgccgacugcauccgggagcuguauuccaagaacgaggcccagcaacgcaaccucgccgcccgcgacuucgugcaucuauucguggaggacaucaucuucuaccagcggagccugcgccggcagaaguccacccucgcgaacugcagccuggagucccgcuccuacaucgacaaggacagccauacucggaaggaggccccgcugaaagugugucccaaguccaaccccuacuaccaggaguuccgcguccuccaguggcugcagaaccugaagaucuacgagaucgacacagaccaggaggugacgcacgaguucaucaagacccucgaggacaagcagcaguucuucgacuuccugaugaaccagaaggagauagacugugaggagcugcucaaguacuuccugaaccagaccuaccccaacgcccgggagaaggcccucaagagcgagcucaagaaauggaaagauaccuaccgcuggaacuacguguacgacaucggggagaaguccagcaagaaguacccgaugaacgagacgcgguacgagcugaagcgccaccuggagaagguagccaaccugcccgacgacuuccucuccagcgagguggaguaccugcuguggcaccucaucuacuccgucaaggacaaggucgcguacgagaagggccugaagaccuuugcacagaagcaccaucuggacaaggacagcuucguggaguccuucaagaaauucaagcccuaucccagcgaguacggguccuucagcgagaaggccauccggaagcuccugccgcugaugcgcuucggcuccuacugggacuucaaccacaucgacaagaacacccagaagcggaucgaggaccucaucaccggcguggagaacgaagaaauccgcacgauccugcgggagaaggccgagaaguaccaauuagagaaggagaccgacuuccaggaccucccccuguggcuggcccaguacaucguuuacaacaggcacgcggaggccagcucccucgagaaguggaccagcgugaacgaccuggagaccuaccugaacgaguucaagcaguacucccuccggaaccccauugucgagcaggucgugauggagacucugcgcguaguucgggacaucuggcagcaguacgggcagggacaagccagcuucuucgacgagauccacaucgagcuggggcgcgagcucaagaagaccgccaaggagcgcgagaaacugagcaagcagaaccagaaaaacgaagacaucaaccuguccaucaaggagaagcucaaggagcuggagaaguacaacacccgggccuauagcaucacgcaccaggagaaguacaagcuguggcucgagcagaaacacaucucccccuacacgggccagaucaucagcccggagaaccuguuuaccgacaacuacgagaucgaacauauaauuccccagucccgcuucuucgacgacagccuguccaacaagguggucugcgagagcaucgugaacaaggcgcccuacaaggaccggcagcucgggcuggaguucaucaagaaccagggcggccgcaucgugaaggaacugaguaccgagaacaagacaaucaagaucuucacggaggagcaguaccgcaccuucaucaaggagcacuacagcaacaaccccgagaagaccaagaagcuccugcuggaggagaucccggagaagauggucgcccgccagaugaacgacacgugcuacauaucuaaguuuaucagcgagauccuguccaagaucgugcggagcgacgagcaggacgagggggugcacuccaagaacgucauccugugcaccggcaagaucaccagcgcccugaaacaggacuggggcgugaacgacguguggaacgaccucauccugccccgcuucgagcggaugaacgaccugacccaguccacccucuucaccacguacaacgagaaguaccagaaguaccugcccaccguccccauggaguacagcaacggguuccagaaaaagcgcaucgaccaccggcaccacgccauggacgcgaucauuaucgccugcgccacccgagagcacaucaacuacaucaacaaccagcacgcccuggagaaggguaaggacaagaaagagaaacagaaggagcacgacaaacuucgggagaagcugugcaucaagaaggacaacaagggcagcgaggagaacuacuccuggaucuucaagaagccgugggacaccuucacgcaggaggugcaggccgcgcuggaaggcaucguggugagcuucaagcagaaccuccgcguaaucaacaaggcuaccaacuacuacgaacgguggguggaggaaaacggcaaguauauaaagaagauggucaagcaggagggcacgaauugggccauccgcaagccccugcaugaggagacaaucuccgggaagaucuaccuggaccgggaggagaucacgaagaacgacauucucacagccacccgcaagacuguggacagcuccuucgacgagaagcgaaucaagaagaucacggacaccggcauccagaagauccugcugaacuaccugaaguauaaggggagccccgagaucgccuucuccccggagggacuggaggagcuuaacaagaaccucagcauauacaacgacggcaagccccacaagcccaucuacaaggugcgcaucuaugagaagggcuccggccgguucgcgcugggagagaagggccgcaaguacaagaaguacguccaaggcgcccccaacuuauacuuugggaucuaccagggcgccaacaagcguagcuucgccaccauaccacucaacgaggugauugagcggcaaaagcaggggcgccccuccauccccgaguacaacgagaaaggcgacccccuacuguucagccuauccccgaacgaccugguguacgucccuguggagggggagaucauagaggacauugacuuccagaaccugagcaaggaacagaaggagcggaucuacaacguaaacgacuucuccagcacgugcuacuucacccccaaccgcaucgccaaggcgaucuuccccaaagaggucgaccuccaacggaagggcgacaagcugccgggcuccuacgacaccaagaccgccagccuggagggaauccagaucaaggaggugugcaucaagcucaagaucgaccgccuggggaacaucuccaaggccuga

SEQ ID NO: 8009 - RNA, 4317 nt, Artificial Sequence
  Cas9 variant
augaagaccauccugggccuugaccuggggaccaacagcaucggcugggcccugaucaagcagaacuucgagaacaaguacggggagauccucgguauggggucccgcaucauccccaugagccaggacauccugggugaguucggcaaggggaacuccgugagccagacggccgcgcggaccgacuaccgcgccacccggaggcugcgggagcgcuuccuccuucggcgcgagcggcugcaccgcguccuuaacgugcugaacuuccugccggagcacuacgccucccagaucgacuucgacaagcgguucggcaaauucaagguggagaccgagcccaagcucgccuggaagaacaucgacgggaaguucagcuuccuguuccagacgaguuucaacgagaugcuggaggacuucaaggcccacggccaggaccucaagguccccuacgacuggaccaucuacuaccugcgcaagaaggcguuaagccagaagaucgagaaggaggaguuaguguggauccugcugaacuucaaccagaagcggggguacuaccagcuacgcggcgaggaggaggaggagaaccccaacaagcugaucgaguuuuacucccuaaagaucaucgacgugcucgccgacgagccacagaaaggcaagagcgacaucugguacucccucguccuggagaacggguggaucuaccggcgcagcuccaagaccagccuccuggacuggaaggacaagauccgggacuuuaucgugaccacggaccugaacgacgacggcuccgugaagaccgacaaggaggggaacgagaagcgcagcuuccgggcccccggcgagaacgacuggacccucgucaagaccaagacggagcaggagaucgaccgcucccggaagaccgugggcaacuacaucuacgagacccugcugcagaaccccaagcagaagaucaaggggaagcucgugcggaccaucgagcgcaaguucuacaaggaggagcugaagcggauccucgagaagcagaaggaguuccaucgcgagcucgagagcaaugaccuguacaacgacugcauccgggagcuguaccgcaacaacgaggcccaccagcucacgcuguccaagaaggacuucguccaccuguucauggaggacaucauauucuaccagcggccccucaagagccagaaguccagcaucagcaacugcacccuggaguuccgcaaguacaaggacgagaacggcaucgagcacacccaguuccugaaggcgaucccgaagaguaaucccuacuaccaggaguuccggaucuggcaguggaucuucaaccucaacaucuacaagaaggacaacgacgacaacguaacgaaggaguuccugaacacgacccgcgacuucgagaaccuguucgaguuccucaacaaccggaaggagaucgagcagaagccccugcugaaauuccugcucgagcagaaggaguucaaggggaaacugcugaacgccgagaccgagaaguuccgcuggaacuacguggaggacaagaaguaccccugcaacgagacccggacgaugaucagcgagcgccucaagaaggucgagaacaucuccgacgacuuccuaacccgggagauggagcagaagaucuggcacaucaucuacagcgugaacgacaagaccgaguacgagaaggcccugaaguccuuugccgagaagaacaaccucgacgagaacagccuguucgaggccuucaagaagcugccgcccuucaaguccgaguacggcagcuucuccgagaaggcgaucaagaagcuccuaccccugaugcgccucgggaaguacuggagcuacgccaagaucgaccuguacuccaagaaccggauccagaagaucaucaccggcgaguucgacgagaacaucaaggaccgcgugcgggagaaggccauccgccugacggcagagaacgacuuccagggccuccagcuguggcuggcccaguacaucgucuacgggcggcacagcgaggcguccaugaucggcaaguggaacagcgccgacgaccucgaggaguuccugaaggaguucaagcagcacucccugcgcaaccccaucguggagcaggucaucaccgagacccuccgcaucguuaaggacaucuggcugaaauacgggaacggcgccaaggacuucuucaacgagauccacaucgagcugggacgggagaugaagcagaccaaggacgagcgcgccaacgccacgaaaaccaucaccgagaaugagaacaccaaccuccggaucaaggcgcugcuggccgagaugaugaacgaccacagcguggagaacgugaggccguacucccccaugcagcaggagauccucaagauauacgaggacggcauccucaagagcgauaucgagaucgacgacgauauccucaagauaagcaagacggcccagcccuccagcuccgacuugaagcgguacaagcuguggcuggagcagaaguacaagagccccuacaccggccagaucaucccgcucaacaagcuguucaccccugaguacgagaucgagcacaucaucccccagucccgcuacuucgacgacagcuucuccaacaagaucaucugcgagagcgccgucaacaagcugaaggauaacuacaucgggcucggcuucaucaagcaguucgggggcaccaucaucgagugcggguucggcaagcggguaaaggucuucgaggucggcgaauacgaggaguucgugaagaagcacuacgccaacaacagggggaagcggaacaagcugcugcucgaggagauccccgagaagaugaucgagagacagaugaacgacacccggcacaucuccaaguacaucagcggcauccugucucacaucguccgcguggaggacgggacggacgagggcgugaacagcaagaacgucaucccggggaacgggaaaaucaccacgcagcugagacaggacuggggacucaacgacguguggaacgagcugauccugccccgcuucgagcggaugaaucaacucaccaacuccaccgacuucaccagcuggaacgagaaccaccagaaguaucuacccaccgugcccgucgaguucuccaagggguucagcaagaagcgcaucgaccaccggcaccacgcguuagacgcccucgugaucgccugcgccaccaaggaccacgugaaccugcugaacaaccaguccgccaagagcgcgacgaagcgcuacgaccucaagaagaagcugaugaaguucgagaagaccgucuauaaggacccgcagaccgagaagcggaucgagcgcgaagugcccaagcacuuccugaagcccugggagaccuucacgguggacgccaagaaccggcucgagaccaucaucgucagcuucaagcagaaccugcgcgugaucaacaaggccaccaacuacuacgagaaguauguggagaaggacggggucaugaugaaggagcgcguggagcaaaccgggacgaacugggccauccggaagccgaugcacaaggagaccgucuccggcaagaucgaccugcccugggucaaggugcccaagggcaagauccucaccgcgacccgcaaaagccuggacacguccuucgaccugaaggccaucgccagcaucaccgacaccgguauccagaagauccucaagaacuaccuggaguucaaagaguccccugagcuggccuucagcccggagggcaucgaggacaugaacaagaacauugagaaguacaaugggggacggccccaccagcccaucuccaaggugcgcgucuuugagcucgggagcaaguuccaggucgggcagaccggcaacaagaaggacaaguacguggaagccgcgaaggggacgaaccuguucuucgcuaucuacgaggacaagaagggcaagagguccuacgagaccaucccccugaacgaggucaucgagcgccagaagcaagggcucagcgugguggaccugaagaacgucaacgacuucuuccuguguccgaacgaccucguguacauccccucgggcgacgaguucgagaaccgggggagcaucgagaucgaaaacaucaccaaggagaaguccgaacgcuucuacaagguggucagcuucuccgguagccagaucuucuucgugcggcacgacauugccguguccaucguuaacaagggcgaguucucgacccugaacaagauggaaagagccaucgacggguccauggugaaagagaucugcaucaagcugaagaucgaccggcucggcgacgugcugaaggccuga

SEQ ID NO: 8010 - RNA, 4317 nt, Artificial Sequence
  Cas9 variant
auggugaagaagggcuacaccaucgggcuggacaucggcaccacgagcguggggugggccgugaccgacgacgacuucgagcucgugaacaagaagauguccaucaaggacaagagcggcuccaccaucaagcgcguccggaagaaccuguggggcgugcgccuguucgacgaggccaagaccgcggagaacacgcggcgcacacgcggggugaggcgcaggauccgaagacggaaggagcgccucaacuaccugcagggcaucuucagcuccgagauggccaagauggacgagaacuucuucaugcggcuggaggagagcuucuucaagcucuccgacaagagcgagcagaacaaguuccccuacgcccuguucaagaacgagaucgaggagaaggcuuacuacaggcaguuuccgaccaucuaccaccuccggaagcaccucauggagcacgaggaguccgaccugcgcaagauuuaccuggggcuccaccacauacugaaguaccggggccacuucguucaagaggggcagaagauggacguggccaacaucgacauccaaggcaaccugaaggagcuguucaacgcgcuuaacgagaacuucucaaacaaggaggacgacuucgagcaggagcgcaugaaggacggugugaagcgggccaagguccuguucgacaccgagaagcucgccgccguggaggagauccugaaggagaagaucuccaaguccuggaaggugaacaagaucuccaagggcauucuggcugagaagaaggaccuccccaucuucaaggccaucgucggcaacaagaucgaucuggccgggauauucgacugccccgacuacgccgagaaagugaacgagagcaucaaggagcugaaggacaagguguacuucaacaaggaggauuucgaggaaacauucgagaaacucucccagcuucugaaggaggaggagcucgagauauuaauccuggcccgcaagugcuacgaggcgguccuuuuagccgacaucaugcagggcgagcagagccuguccgacgccaugguggccaaguacaacgaccacaagaaagacuuggugaucuuuaagaaguucgucaucgacuauuuuagcgaggacguuuacuuugaccuguucaagaacacccagcuagccgggaacuaccacuccuacgugaagggcgagcggaagggcaacaaguucaaccacgcgagccucgacgacuucuacaaguucgucaaaaaggaacuggacaagaaggccgaggagcuaagcgagcaccccguauacaagcagauccuccagaagaucgagcuggagaccuuccugccgaaacagcgcauguucaagaacggggccauccccuaccagguccaccuccacgaacugcgcgccaucaucaagaagcaggaaaagcgguucccguuccuggccgagaagaucaucaucaaagacaaccagaaggacaucuccgaguauaagaucgagacgcucaugaaguuccgcauccccuacuaugucggcccgcugaucgaggcgcgggagggggagcugggcaagaagcgcacgaacuacagccgguucgccuggaugcagaagucccccgagagccagaauaucgggauaacccccuggaacuuccacucuguggucgauaaggacgcuagugcuuccgaguucaucgaacgcaugaccggcuucugcagcuauuuccccgaggagcccgugcuccccaagaacucccugaucuaccagcaguucaccguguuccaggaacugagcauagugggcuacuacgacgagcagaaucggaagcacuaccuggacggggagacacgccggcgcaucuucgaggaccucuucaagaagaaccggaccguguccgccggccugcugcgcaaguggcucgugugcaaccagcggaccagccaggaggagaaagaaaucagacuauucgggcuggaccucaaaaagaacggccugggguccggcaacuucaacaccaaauacacgaccuaccuggaccucaaggacgcgggcaucaccgagaagcagcugaagcagcacaaggacuucuucgagaagaucgucaaguaccagaccauauucgaagacaagaagauccugaagcggcgcaucauacuccugaacgaggagcagccccugcucucagaggagcaaauaaagaaccuggccaagaagcacuacacgggguggggcaaccugucccucaagcugaucgacgggauccaggacaagggcaagacgauucuggacuaccucgagacccaggacuacaaccagaaucugaugcagcugaugaacgacgagaacaagagcuucgagaugcaaaucgagcaggcccgggccgggaaggugcaguucggcaagaucgauuacuccuucguggagcagcucgcgggcagccccgccauaaagcgggggaucuggcagucccugcagaucgucgaggaacugguggccuuccucggcaaggagaacaucaagaagauugugaucgagauggcccgggagaaccagagcucaaagcgcaccaagucccgccagaaacagaucgaggcccuguaucagaaggucacgggggaccugaagaacgagcaggagaagaucgacgugaugcagaauuucgauaacgagcggguguuccucuacuaccugcagaacggcaaguguaugcacagcggcgagaaacuagagcucucccagcugagcgaguacgagaucgaccacaucaucccacagaccuacaucaaagacgacuccuucgacaacaaggugcuugugaccagaaacgccaaccagcagaagggcggggacgugcccagcuacgacguaaucgacaagaugaaguccuacugggagaagcucaaggagaacaaccugaucagcgaaaagaaguucgccaaccugaccaaggggaaguucgacgaccagcagcucuccggcuucaucaaccggcagcugguggagacgcgccagaucaccaagaacguggccaucauccuagacaagauuuacaacgacgaggccaagaacgagaaggaagucgccaucaucacccucaagagcgcgcugaccucccaguaucggcaggggaucaucuacgugcccaacgacgacuucgacgagcugaagcucgugagcaagacgaacucccgccugaaggaggucaagcuacacgacggcuucuacaaggugagggagaucaacgacuaucaccaugcccacgacgccuaccucaacaauguggucgccaccuaccuguacgaggccaugcccgaccugcgcccccucuucguguacggggagcacagucgggagauccacaagcgcuuccuggggaaguacgcgaccaccagaaagggccaguucaagcagcuguuaguggacaugcaggacgaguacuggaugcgcaaggacaaagaggggaacuucaucgacggcgagauccuguggcggcgcgaugagguccugcagaucgugaagaagguucuagacuaccggaacauccagaucacgaagaagcuggagaugauggucaccgggggugaggagaagucguucuaccaggacagccgcugccgaaaggacaaaacggccaucccguauaagaccaacugggaccccuccaaguacggcggguucaagucaccccggaccgcauacgccaucccggugaucaagaagaacaaacccaaacuggagcccgugcuccucgucaaccggagcaaaguggagacggacggccaguucgacugcgagaaguucaaggaguuaaaccccacccucaagauccuggggcagccgaucuggaaguaccaguccuucgagauguuugacggcaccaagcgcuacaucgcgagcgcgagugagauccacaaggggaaccagaucaaguucucccaagagcacaugaaguucaucuccugcugccagaaauacgacgaggugaagaacaaacuggccuucgacuucgucaacgagagcaagcaccucuuccaggagauccugaccgccaucaaggacaacauccaccgguaccgccugaucgcggagggcaucgaggugcaccgcaaguucuccaacaugcuagagaacaucgagaagcugagcacgcaggagcugguggacaaccuccuggacgcgaucaacaucaccuccgucggcaccaccaacaacgccuucgggcgggugcgcuacaaaggcagcuaccugaacgaaaucugguccgccacgcucauccaccagagcgugaccggucuguacgagacccgggagaagcugaucuga

SEQ ID NO: 8011 - RNA, 4323 nt, Artificial Sequence
  Cas9 variant
augaagaccauccugggccucgaccuggggacgaacagcauaggcugggcccugguagaacaggacuucgagaacaagcaggggcuaauccugggcauggggucccgcaucaucccgauggacgccggcaucaucggcaaauuugcggaggggagcaguaucagccagacugccgagcggacgggauaccgcuccauccggcgccugcgggagcgccaccuucugcggcgcgagcggcugcaccgcguccucaauauccuaaaguuccuuccggagcacuacgccgccgaaaucgacuuugagaagcgguucgggcaguuccucgccgagaccgaacccaagcuggcguggaagaagucagccgagggcaaguuugaguuccuguuccagcgcagcuucgacgagaugguggccgacuuuaaggccaacgggcaggacaucaagaucccauacgacuggaccaucuacuaucuccggaaaaaggcgcugacgcaaaagaucagcccccaggagcuugcguggaucauacucaacuuuaaccagaagcgcgguuacuaccagcugcggggcgaggaggaagaggagaacccgaauaagaagguggaguucuacucccuaaagaucguugacgugguggccgacgagcaacccaacaagaagggggacaccugguacucccuccaucuggagaacggcugggucuaccgcaggucuagcaagaucccccuguacgacuggaaggacaagguucgcgacuucaucgugaccaccgacaucaacgaggacggguccgagaagcucgacaaggacggcgaggucaagcggagcuuccgcgcccccaaggaggacgacuggacgcuuauaaagaagaagaccgagcaggagaucgagcaguucaaccagacggugggcuccuacaucuacgaggcucugcuugacaacccgacccagaagauccggggcaagcugguccgcacgaucgagcgcaaguucuacaagagcgaacugaagaagauccucgagaaacagaucgagcugcagcccgagcuguucaccgaggaccucuacaacgcgugcgcccgggagcuguacagguccaacgucgcacaccagcagcagcugagcucccgggacuucguguaccucuuccugaacgacaucaucuucuaucaacgcccgcugcggagccagaaguccuuaaucagcaacugcagccuggaauuucgcaccaucaaggacaaggacggcaacggccagaucaucuaccugaaggccaucccuaaguccaacccauacuaucaggaguuccggguguggcaauggcucuacaaccugaagaucuucaccaaggaggacgacaaggacgucacgaaccaauucaucaacaagguggaggaccuggaggcacucuucgaguuccugaugaaccagaaggaggugaaccacacugacauccugacauaccucauugagcccauagucaagagcaaguaccccaacgcgaaaggcaaggccuucaaagacgagcugaagaaggagcugaagaaguaccgcuggaacuacguguacgacgccgacaaggacgaguccaaguccuaccccaugaacgagacccgguacgagcugcgcaagcgguuagacaagguggagaacgucccggccgacuucaugacgcguaagaucgaacagcaccucuggcacauaauauacuccgugaccgacaagaucgaguucgagaaggcccucaagucauucgcgaacaaguacgaccugcaccaggaguccuucguggagaacuucaagcgguucaagcccuucgacagcgacuacgggacauacuccgagaaggccaucaaaaagcugcugccccucaugcgcgucggcaaguacuggagcugggagggcaucgauaacaacacaaagaagcgaaucgggaagauuaucacgggcgaguacgacgaaaccauaaagaaccgcgugcgggaaaaggccaucgaccugaccgaggagaaccacuuccagggucugcaacucuggcuggcccaguacaucgucuacgaccgccacuccgaggccgacaucgcgggcaaguggaacagcguggcggaccuggagcaguaccucagcgaguucaagcagcacagccugcggaacccaaucguagagcaggucaucaccgagacgcugcgcguggugcgcgacaucuggaagcaauacgggaagggcgccaaggacuacuucgacgagauccacaucgagcucggccgggagaugaaaaacaccgccgaggagcgcaagcgucuguccucgaucaucuccgagaacgagaccaccaaccugagaauccgggcaauucucgaggagcugauguacgacgagaacauggagaauguccgcccguacagccccaugcaacaggaggcacugaagaucuacgaggacggggugcucuccucgagcguggagauucccgaggacaucgagaagaucagcaagaaguccgagcccaccaagagcgagauccagcgguacaaguuauggcuggagcagaaguaccggagcccguacacgggccggcccaucccccucuccaaacuguucacccccgccuaccagaucgagcacaucaucccgcaggcccgcuucuucgacgacggguucagcaacaaggucauuugcgaguccgagguuaacgcccugaaggacaagaugcucggccuggaguucauacagaacuacuacgggcagaaggugaccacgagcuucggcgaggucaccauccugaccgaggacgcguacaaggccuucguaaaggagcacuacgacaagaaccgguccaagcgcaacaagcuccugcuagaggagauccccgagaagaugaucgaccggcagaugaacgacacacgcuacaucucuaaguacaucuccaaggugcucucaaaccugguccggggcgagaaggacgacgagggggugaacuccaagaacauuauccccggcaacgggaagaucagcggcacccugaaacaggacuggggccucaacgacguguggaacgaccugauccugccgcgcuucgagcggaugaaccagcucacuaacuccaccgacuucaccgccuggaacgagaaacaccagaaguuccugcccacuaucccccuggagcucagcaagggguuccagaagaagcgcaucgaccaccggcaccaugcccuggacgcccugauuaucgcgugcgccacgcgcgaccacgucaacuuacugaacaacaagcacgccaagagccggaacgagcgcuacgaccugcagcacaagcuccgccacaccacaccguggcaggacaaggaaggcaaggugcggaccaaguucacagaguucaagaagccgugggaaaccuucacccaagacaccaagaaggagcuggagaagaucguggucuccuucaagcagaaccugcgcguaaucaacaaggccacgaacuacuacgagaagaucguggacgggaagaaggucauguucaagcaggagggcgugaacugggccauccggaagccaaugcacaaggagaccgugagcgggaagaucgaucucccccgcgucaagguguccaagggcaaaaucuuaaccgcuacccgcaaaagccuggacacauccuucaacgccaagaccauccucagcaucaccgacaccggcauacagaagauccugcugaacuaccucaaggcuaaggggaaccccgagcuggccuucuccccggaggggaucgaggagaugaaccagaacaucagccuguacaacgacggaaagccucaccagcccauccucaaggugcgggucuucgaacagggcuccaaguuuccacugggggagacgggaaacaagaccaccaaguacguggaggcggcuaagggcaccaaccuguucuucgggguguacgagaacaaccagggcaagcggagcuacaacacaaucccgcucaaccuggucaucgagcgccaaaagcaggggcuuaauuccgugcccgagaccaacgagaagggccaccggcuccuauucagccugucccccaacgaccucguguauguccccauagagggggagguguucgacaagaccaacccggacgugaaccgcaucuacaagaucgucagcuucuccgguagccagauguucugcguacgucaggacguggccaccuccaucgucuacaagcuggaguucagcucccugaacaagauggagcggacgaucgacggaaucaugaucaaggagaucugcaucaagcucaagguggaccggcuggggaacaucagcaaggccuga

SEQ ID NO: 8012 - RNA, 4323 nt, Artificial Sequence
  Cas9 variant
augaagaccauccugggucucgaccugggaaccaauagcaucggcugggcccugguggagcaggacuucgagaacaagcaggggcucauccuggggauggggagucgaaucauccccauggacgccggcaucaucggcaaguuugcggaggggagcucgauuagccagacggccgagcggaccggcuaccgcuccauccggcgcuugcgagaaaggcaccuccuacgacgagagcggcugcaccgcgucuugaacauccuuaaguuccugccggaacacuacgccgccgagauagacuuugagaagcgguucgggcaguuccucgccgagaccgagcccaagcuggcguggaagaaaaacgccgagggcaaauucgaguuucuguuccagcgcagcuucgacgagaugguggccgauuucaaggccaacggucaggacauaaagauccccuaugacuggaccauauacuaccuccggaagaaggcgcugacgcagaagauaagcccccaggagcuggccuggaucauccucaacuucaaccagaagcgcggcuacuaccagcugagaggcgaggaggaagaggaaaacccgaacaagaagguagaguucuacagccucaaaaucguggacgugguggccgacgagcagcccaauaagaagggggacacuugguacucgcuccaccuggagaacggcuggguuuaccgccggagcuccaagaucccucuguacgacuggaaggacaaggugcgcgacuucaucgugacuaccgacaucaacgaggacgggucagagaaguuggauaaggauggcgaggucaaacggaguuucagagcccccaaggaggacgauuggacgcugaucaagaagaaaacggagcaggagaucgagcaguucaaccagaccgugggcagcuacaucuaugaggcccugcucgacaacccgacccagaagauccgagggaagcuagugcgcacgaucgaacgcaaguucuacaaguccgagcugaagaagauccucgagaagcaaaucgagcugcagccggagcuguucaccgaggaccucuacaacgcgugcgcccgugagcucuaccgccggaacgucgcccaccagcagcagcucagcucacgcgacuucguguaccucuucuugaacgacauaaucuuuuaccagcggccccugcgcucccagaagucccucaucagcaacugcagccuggaguuccggaccaucaaggacaaggacggcaacgggcagaucaucuaccugaaggccaucccaaagagcaacccguacuaccaggaguuccgaguguggcaguggcucuacaaccugaagaucuucacaaaggaggacgacaaggacgucacgaaccaguucaucaacaagguggaggaccuggaggcccucuucgaguuuuuaaugaaccagaaggaagugaaccacaccgacauccugaccuaccucaucgagcccaucgucaaaagcaaguaccccaacgcgaagggcaaggccuucaaggacgagcugaagaaggaguugaagaaguaccgguggaacuacguguacgacgccgauaaggacgaguccaagagcuaccccaugaacgagacccgcuacgaacugcggaagcgccucgacaaggucgaaaaugucccggccgacuucaugacgcggaagaucgagcagcaccuguggcacaucaucuacuccgugaccgacaagaucgaguuugaaaaggcacucaagagcuucgcgaacaaguacgaccuccaccaggaguccuuuguggagaacuucaaacgcuucaagccauuugacagcgacuacgggaccuacuccgagaaggccaucaagaaacugcugccccuaaugcgggucggcaaauacuggagcugggacaucaucgacgacaagaccaagacccgcauaggcaagauaauaaccggggaguacgaugagaccaucaaaaaccgggugcgcgaaaaggccauugaccugaccgaggagaaccacuuccagggcuuacagcucuggcuggcccaguacaucgucuacgaucggcacuccgaggccgauaucgcagggaaauggaacagcguggccgaccuggagcaguaucucuccgaguucaaacagcauagccugcgcaaccccaucguggagcaggucaucacggagacccugcgaguggugagggauaucuggaagcaguacggcaagggggccaaggacuacuucgaugagauccacaucgagcucggccgcgagaugaagaacacagccgaggaacggaagcgccugaguagcaucaucuccgagaaugagaccacgaaccugcggauacgcgcgauccucgaggagcuuauguacgacgagaacauggagaacguccggccuuacucucccaugcagcaggaggcacugaagaucuacgaagacggcgugcucuccagcagcguagagauccccgaggacaucgagaaaaucuccaaaaagagcgagccaaccaaguccgagauccagcgcuacaagcuguggcuggagcagaaguaccggagccccuacaccgggcgccccaucccccucuccaagcuguucacccccgccuaccagaucgagcacaucaucccgcaggcccgguuuuucgacgacggcuucucuaacaagguaaucugcgaguccgaagucaacgcccuuaaagacaagaugcucgggcuggaguucauucagaacuacuacggccagaaggugacgaccagcuucggggagguuacaauccugaccgaggacgcguacaaggccuucgugaaggagcacuacgacaagaaccgcucaaagcggaacaagcuccugcuggaagagauccccgagaagaugaucgaccgccagaugaacgacaccagauacaucagcaaguacaucuccaagguacucagcaaucugguucgcggcgagaaggacgacgagggugugaacuccaagaacauaauccccgggaauggcaagaucacugggauccugaagcaggacuggggucucaaugacguguggaacgaccucauccugccgcgguucgagcgaaugaaccagcucaccaacagcaccgacuucaccgccuggaacgagaagcaccagaaguuccugccauccgucccccuagaauugagcaagggauuccagaagaagcggaucgaucaccgccaccacgcccuggacgcccugaucaucgcgugcgccacgcgggaccaugugaaccuccuuaacaacaagcacgccaaguccagaaacgagcgcuacgaccugcagcacaagcuccggcacaccaccccauggcaggacaaggaagggaaggugcgcacgaaguucacggaguucaagaagccgugggagaccuucacccaggauaccaagaaagagcuggagaagaucgucgugaauuucaaacagaaccugcgggugaucaacaaggccacgaacuacuacgaaaagauagucgacggcaaaaaggugauguucaagcaggagggggugaacugggccauccgcaagcccaugcacaaggagaccgucagcggcaagauagaccucccgcgggugaaagugagcaaagggaagauccugaccgcgacucgcaagucucuggacacgagcuucaacgcaaagacaauccucuccauaaccgacaccgguauccagaagauccuacuaaacuaccucaaggccaagggcaaccccgagcuggccuucaguccggaggggaucgaggagaugaaccagaacaucucccuguacaacgauggcaagccucaccagcccauccuaaagguccgaguguucgagcaggggagcaaguucccccugggcgagacagggaacaagacuaccaaguacguggaggccgccaagggcaccaaccuguuuuucggcgucuacgaggauaaccaagggaagcgcagcuacgacacgaucccgcucaacaucgugaucgaacggcagaagcagggccugaacagcgugccggaaaccaacgagaaggggcaccgccugcuguucucccugagccccaacgaccuggucuaugugcccauugagggcgaggucuucgacgagaccaacccagacgucaaccggaucuauaaggugguguccuucagcgggucccagauguucugcgucaggcaggacguggccaccagcaucguguacaagcucgaguuuuccagccugaacaagauggagcggacgauugacggcaucaugauuaaggaaaucugcaucaagcugaaggucgaucgccucggcaacaucuccaaggccuga

SEQ ID NO: 8013 - RNA, 4332 nt, Artificial Sequence
  Cas9 variant
augaucaagcugcucuaccuggagaagcugaagcaguacaccaugaagaagauccucggccuagaccuggggaccaguuccaucggcugggcccucgugaacgaggccgagaacagcgacgaggucuccagcaucaucaagcugggggugcgcguuaacccccugacggucgacgagaugcagaauuucgagaagggcaaguccaucaccacaaacgcggaccguacccucaagcgcagcaugcggcgcaaccugcagcgguacaagcugcgccgggacgcccucaucgagcugcugaaaaaggugggguucaucacggacaagaccauccucuccgagcagggcaaccgcaccaccuucgagacguaccggcugcgcgccaaggcggccgaggaggagaucagccugaaggagcucgcgcgggugcuccugaugaucaacaagaagcgcggcuacaaguccucacggaaggccaagggggaggaggagggcgcccucaucgacgggauggagaucgccaagaagcuguacgacgaggaccugaccccgggccagcucugccugcagcugcucgaguccgggaagaaguucuuucccgacuucuaccgcagcgaccugcaggaggaguucaacaagaucugggacuuccagaagcaguucaaccuguucuccuucugcgacgucgcgaaggaggagguuaagggcaagaacaagagccagaccugggccauccucgccaaguacuucguggagacuaagaaggucaacguguggaacgagcacgaggcccagacggagaaccgggaggagguguacaagcuggucggccugaagcgcaccgugaagggggaggagcucaagaaggagaacuaccgguggcgcgugcaggcccugaccgaacagcuggaccucgagaagaucgcggucgugcuacaggagaucaacggccagaucuccgccagcuccggguaccugggcgccaucagcgaccgguccaaggugcucuacuucaaccgccagaccgucggccaguaucagauggccgagcugaacaagaaccccaacaugagccugagaaacaugguguucuaccgucaggacuaccucgacgaguucaacgugaucugggagaagcaggccgaguuccacaaggagcugacgcccgagcugaagaaggagauccgcgacauuaucaucuucuaccagcggcgccucaagagccagaaggggcugaucucauucugcgaguucgaaaaccgggaggucgugguggagaaagagggcaagaagcagaccaagaucaucgggugcaaggucaucccgcgcagccacccucuguuccaggaguucaagaucuggcagacccucaauaacaucgagguguucgucggcgagaagaaggggaagcggaagaaauccaacgugagcucagaccuguucggcgacaccgaggacgcgcugaucacggagggccgccgguuccuguaucaggaggagaagaagauccucgccaaggagcugucgaucaagaaggggcugaccaaggccgagauccuccgcuuacuguucgagaacccccaggagcucgacaucaacuucaagcagaucgacggcaaccaaaccggguucgcccuguucuccgccuacagcaacaugaucgagaaguacggcuacgaaccucuggacuucaagaagccggcggaggaccucaucucccagcugaagaccguguucacggaccugggguggaacaccgaccuccuguucauagaccuggacaaggagaauaaagagugggagaagcaacccuacuuccggcucuggcaccuccuguacucuuucgagggcgacaacacccccaccggcaacggcaagcucaucgagaagaucaugcagcuguguggcaucgagaaagaguacgccaucgagcuggccaacgucucccuccaggacgacuacgggagccuguccgccaaggccauaaagaagauccugcucuaccugaaggagggcaaucaguacgacauggcgugcgaauacgcgggguaccgccacagcaaauccagccugacgaaggaggagauugagaacaaggugcucaaagacaagcuggagauccugcccaagaacucccuccggaacccgguggucgagaagauccugaaccagauggucaacgugaucaauaccgucauggagguuuacggccgccccgacgagauccggguggagcuggccagagagcucaagaaguccgccaaggagcgggaggagcugaccaaggcggucgccaagaacacccgugagcacgaggagauccggaaggugcuucagagcgaguucggcaugaucaacgugagccgcaacgacaucauccgguacaagcucuacgaggagcugaaggacaacggguacaagacgcuguacagcaaccaguacaucccccgcgagaagcuguucuccaaggagaucgacaucgagcacaucaucccacagagucgccuguucgacgacucccugagcaacaagacccucgaguacaaguccaucaacaucgagaagggcaacaagaccgcuuacgacuucgucaaggagaaguacggggaggagggccugcagcaguaccugaaccggugcgagaaccucugcaaggacaagaaggccaagcugcgcaagcugaagauggagcucaacgagauccccgacggcuucaucgaccgggaccugcgcaacacccaguacaucgccaagaaggcgcugagcaugcucacggagauuugccggcgcgugguggccaccaccggguccaucaccgacaaguuacgggaggacuggcagcuggucgacgugaugaaggagcucaaccugcccaaguacgaggcccugggccucguggagguauacgaggacaaggacgggcgcaagaucaagcggaucaaggacuggaccaagcgcaacgaccaccggcaccacgccauggacgcccucacgguggcguucaccaaggacguguucauccaguacuucaacaacaagaacgccgccugggagagcgacuccaaggagcauaccaacaucgucggcaucaagacccgcuacuucgaaagcgggaaggccgugccgccgaucccccugggccaguuccggguugaggccaagugccaccucgagaaccugcuggucuccaucaaggcgaagaacaagguggugacgaccaacgucaacugcaucaagaagaagggcgggaccuacaagaacacccagcagacgccccgcggccagcuccaccuugagaccaucuacgggucgcauaaccaguacgugaccaagaucgagaaggugaacgccuccuucgacgccgucaagaucgccaccgugagcaagcaggacuaccggaacgcgcugcucaagcgccuggagguguucggcaacgaucccaagaaggccuucacggggaagaacucccuggagaagaacccuaucuaccucgaccgggcccagaccauccaggucccggacaaggugcagaccguggagcuggagacggccuacacgauccgcaaacccgucgaccccacccugaacguggacaagguggucgacaagaagauccggcucauccuggagcagcgccuuaaggaguacggcggcgacgccaaaaaggcguucgugaaccucgaugagaaccccaucuggcugaacgaggaaaaggggaucucgaucaagcgggugaccauccgcggcaucuccaaggcccaagcccugcacgacaagaaggacaaggacgggaacuucauccucgaugagaccggcaagcgcauccccgucgacuucgugaacacggggaacaaccaccacguggccaucuaccggaagcccguccuggacaagaagggccagguuaucuucgacgaugagggcaaccccauguacgagcuggacgaggacguggucccguucuucgaggccgugacacgcgcgaaccucgggauccccaucaucgacaaggacuacaagaaauccgagggcuggcaguuccuguucagcaugaagcagaacgaguacuucgucuuccccaacgagaagaccggguucaaccccaaggagguggaccuguuagacccggauaacuacgccaugaucagccccaaccuguuccgggugcagaagaucggccugaacgacuacacuuuucgccaccaccucgagacgaccauccagaacgaccugaaguucaucacuuggauccggugcggcaagagcgggaucaaggacaucgucaaggugcgcaucaaccacaucggccagaucguguccgucggggaguacuga

SEQ ID NO: 8014 - RNA, 4332 nt, Artificial Sequence; identical to SEQ ID NO: 2214
  Cas9 variant

SEQ ID NO: 8015 - RNA, 4341 nt, Artificial Sequence
  Cas9 variant
auggugaaaaacauccugggccucgaccuggggaccaauagcgucggcugggcccugaucaaacaggacuucgagaacaaacagggggacauacucggcaugggcucccgcaucauccccaugagccaggacgugcugggcgacuucggcaaggggaacuccaucagccagaccgccgagcgaacgaaguaccgcuccgugcggcgccugcgggagcgcuuccuccugcggcgagagcggcugcaccgcguccucaacguacuggacuuccugccggagcacuacgcgagccagaucgacuucaacaagcgguucggcaaguucaaggaggagacugagcccaagcucgccuacuccaacgacggguucaucuucaagaaguccuucgaggaaaugaucagcgacuucaagacccaccagcccgaguuacuggagaacaacaagaaggugcccuacgacuggacgaucuacuaccuccgcaacaaggcgcugagccacaagaucgagaaggaggagcuggccuggauccuccuuaacuucaaccagaagcggggcuacuaccagcugcgcggggaggaggaggaggagaacccgaacaagcucaucgaguucuacucccugaagaucguugacgugcuggccgacgagccccagaagggcaagagcgacaucugguacucccucauccuggagaacggcuggaucuaccggcgcagcuccaagaucccccugcucgacuggaaggggaagacgcgggacuucaucgugacaaccgaccugaacgacgacggcagcgucaagaccgacaaggaggggaacgagaaacgcuccuuccgggcgcccggggagaacgauuggacgcuggugaagaagaagaccgagcaggagaucgacaauucugacaagaccgugggcgccuacaucuacgaggcccuccugcagaacccgaagcagaagaucaaggggaagcugguccgcaccaucgagcggaaguucuacaaggccgagcucaagcagauccuggagaagcagauggaguuccaccccgaacugcgccaggacgaccucuacuccgacugcgugcgugagcuguacaagaacaacgaggcgcaccagcugacgcucagcaagaaggacuucgugcaccuguucauggaggacaucaucuucuaccagcguccccugcgcagccagaaguccagcaucuccaauugcacacuagaguuccggaaguacaaggacgagaacggcaccgagcacauccaguaccugaaggcccugcccaagucuaacccguacuaccaggaguuccgcaucuggcaguggauguacaaccucaacaucuacaagaaggaggacgacaccaacgucacgaaggaguuuuuaaacuccaaggccgacuucgagagcuuauucgaguuccucaacaacaagaaggagguggaccagaaagcccugcugaagcacuucaagaucaacgacaagacccaucgguggaaguacguggaggacaagaaguaccccugcaaugagacuaagaccaugaucuccgagcgccugaagaaggucgagaacaucagcgacgacuuccucacgcgggagauggagcagaagaucuggcacaucaucuacuccgugaacgacaaggugaaguacgagaaggcccucaagagcuucgcggagaaaaacaaucuggacgaguccuccuucuucgaggccuucaagaaguucccgcccuucaaguccgaguacggggccuucagcgagaaggccauuaaaaagcuccugccccuaaugcgccucggcaaguacugggacgacgacgagauccugaaguacuccgacaucuacuucaagaacaucgaauaccugcucgggguccugaagcagaaggacaagaacaucagcgacgacaaccggcagaacuggaacaaguccaucaacaacaagcugcgcgaggagcucgagaucuuccagaacgccgaaaucgagagcuuccagggccugcggcugcacaucgcgcaguacauccucuacggccgccacuccgaggccgccaugcuggggaaguggaacuccgccgacgaccuggaggaguuccucaaggaguucaagcagcacagcuuacguaaccccaucguggagcaggucaucaccgagacccugcgcguggugaaggacaucugggucaaguacggcaacggggccaaagacuucuucaacgagauccacauagagcucggccgggaaaugaagcugcccgcagaggaccgcaagaagaucaccaaccaaaucagugagaacgagaacacgaaccugcggaucaaggcccucuuagcggagaugaugguggacucuuccguggagaacguccgccccuucagcccgaugcagcaggagauccucaagaucuacgaggacggggugcucaacuccgacaucgagaucgaggacgacauccugaagaucucgaagaccgcccagcccucccccagcgaccugaagcgguacaagcucuggcuggagcagaaguacaagucccccuacaccggccagaucaucccgcugaacaagcuguucacccccgaguacgagaucgagcacaucaucccccagagucgauacuucgacgacuccuucagcaauaaggugaucugcgaggccgcggucaacaagcugaaggacaacuucaucggccugggguucaucaagcaguucggcgggacgaucguggagugcggcaacgggaaguccgugaccguccucaaggaggaccaguacgaggacuucgugaagaagcacuacgccaacaaccgcucaaagcggaacaagcugcugcucgaggacauccccgagaagaugauagaacggcagaugaacgacacccgguacaucuccaaguacaucagcggcgugcuguccaacaucguccgcaccgaggacggcacggacgacggggugaacagcaagaacaucgugccgggcaauggaaagaucaccaacacccugaagcaggacuggggccucaacgacaucuggaacgaccugauccugccccgguucgagcgcaugaaccagcucaccaacagcacggacuucaccgccuggaacgagaaccaccagaaguuccugcccaccgucccgguggaguucuccaagggcuucagcaagaagcggaucgaccaccgccaccacgcccuggacgcgcucgugaucgccugcgccaccaaggaccacgucaaccugcugaacaaccaguccgccaaaagcgacaccaagcggcacgaccucaagcgcaagcugaugaaguucgagaagguggccuacaaccacccccagacgggggagcggaucgagcgcgaggugcccaagcaguuccugaagcccugggagaccuucaccgucgaggcgaagaacggccucgagaccaucaucguguccuucaagcagaaccugcgggugaucaacaaggccacgaaccacuacgagaaguacgucgagaaggacggggccaaagugaagggccgcguggagcaggccgggacuaacugggccauccggaagccgaugcacaaggagacugucagcggcaagaucgaccugccccgcaucaaggugcccaagggcaagauccucaccgcgacgcggaagaaccuggacaccuccuucgaccugaagaccaucgggagcaucaccgacacgggcauccagaagauccucaaaaacuacuugcaguacaaggacaacaaccccgagcuggccuucuccccagaggggaucgaggacaugaacaagaacaucgagaaguucaacgacggcaaggugcaccagcccaucaucaagguccgcaucuuugagcucgggucuaaguucccccugggccaguccggcaacaagaaggacaaguacguagaggccgccaaggggaccaaccuguucuucgccguguacgaggacaaaaacggcaagcggagcuacgagaccaucccccucaacgaggucaucgagcgccagaagcaggggcugacagugguggaucugaagggcgucaacgacuucuaccucuccccgaacgaccugguguacgugcccagcgaggacgagcuggagaacgucuccaugaucgacuacaauaaguugagcaacgagaagguguacaagguggucuccuucacggggaaccagaucuucuucgugcggcaggacguggcgaccagcaucgucaacaaggccgaguucuccagccugaacaagauggaacgcgccaucggcggcaccaugaucaaggagguguucgugaagaucaagaucgaccgccuugggaacaucagcaaagucuga

SEQ ID NO: 8016 - RNA, 4347 nt, Artificial Sequence
  Cas9 variant
augaagcacauccugggccucgaccuggggaccaauagcaucggcugggccguggucaaggaggcccagaacgacaacgagcaguccgagaucguggacgugggggugcgcgugaacccccugacaacggacgagaagaccaacuucgaaaagggcaagccgaucagcaccaacgcggaccggacgcucaagcgcuccgcccggaggaaccugcagcgguacaagcugcgccguaaggagcucaucgagcugcugaaggagcaccagcugauuagcgagaacacgauacuaaccgagaacgggaaaggaacaaccuuccagacucuggagcuccgcgcuaagucugccaaggagaagaucucccugggcgagcuggcccgcguguuccucaccauuaacaagaagcgcggguacaaguccagccggaaggcgaagaacggcgacgaggggcagcugaucgacggcauggagaucgccaagcgccuguacgaggagaaccucaccaccgggcagcugucccugcagcuccugaaggagggcaagaagucccugccagacuacuaccggagcgaucuccaguuugaacuggacaaggucuggaacuuccagaaacagagccacuccgacauccugacagacgaguucuacgcccagcucaaggguaaggggcagcgcgccaccagcgcgcuguuccucgccaaguaucagaucuacacugcugagaacaagggcucccgggaggacaagaagcuccaggccuaucaguggcgcguggaugcccugagcaaggagcuaacccgggaggagcucgcguucgugaucacggagaucaacaacaaccugaacaacuccagcggcuaccugggcgccaucagcgaccgcaguaaagagcuguacuucaacaaugagaccgucggcgaguaccuauggaagcagaucgccgccaacccccacaacagccugaagaaccagguguucuaccggcaggauuaccucgacgaguuugagcagaucuggaagacccaguccgccuucuaccccgagauccugaccgacgagcuaaagaaagagcuccgcgacguggucauauucuaccagcggaaguuaaaaagccagaagagucuugugagcuucugcgaguucgagaacaaggagaucgagaucaaaaacgaggacgggacgaccaccaaaaaggugaucggcuugaaggucgcgccgaaguccagcccccuguuccaggaguucaagaucuggcagaaucuuaacaacgugcucauacgcaagaaggggucgaagaccaaaaagguugcuaagaaucagcaggccguccuguucgaggaggagaagaccaucagcgagcuggaucuggaggcgaagcaggcccucuucaacgagcugaaccugaagggcaaccucaaggcggacuacugccuggagauccugggguacucccccaaggagugggagaugaacuacagcauccuggagggcaaccgcaccaacaaggcgcuguacgaggccuaccugaagaucaccgaccucgagggguacgaugccaagaaccaccugaaggugaagcugaacaaggacgagguggagcucgacgaccugaagguccccgccucugagaucaaggacauggugcaggcgauauucaaggaggccggcaucaauaccgacauccuucacuucaacgccgagcucgacgguaaggacuucgagaaccaggccagcuaccagcuguggcaccuccuguacuccuacgagggggaugacucuaaguccggcaacgaacugcuguacaagcuccuagagacaaaguucggguucaaaaaggaguacgcgcaaauucuggccaacgugagccucuccgacgauuacggcaaccugagcaccaaggccaugcgggaaaucaucacacaccugaagcagggcuucccguucaccgggcgcaaggaccggcccgacgaacccuccgccugcgaguucgccggcuacaagcacagcaagcacagccucacgaaggaggagaacgagaagcgaguccugaaggacucccuggaggugcucaagaagaacagccugcggcagcccgucguggagaaaauccugaaccagaugaucaaucucgugaacgcgcugcugaagaaguaccgcaccgagaacccgaacuucaaguucgacgagauccggaucgaacucgcccgcgagcuuaagaagaaggccgaggagagagccaacaugacggccaacaucaacaaggcgaagaccgagcacgagaagaucaucaagauucugaagaacgaguucggccuccccaacccgacgcgcaacgauaucauccgguaccgccuguacgaggaacugaaggacaacggcuacaaggaccucuauaagggggacuacaucccacgggagaagcuguucuccaaggaaaucgacauagagcacaucaucccgaaggcccgcgucuucgacgacagcuucuccaacaagaccaucaccuaccgaaagaccaaccuggagaagggcgagcgcaccgcguacgacuacaucgagagccucggcgagaagcagcuggaggaguuccugucccggauugagaacuuauacgaaaucgggaagcccagccgccugcacaaccggcgcaacccgcugaaaaagguggaggaaaagggcaucuccgacagcaaguacaagaagcuccugaagaaggaguccgagaucggcgacggcuucguggaacgcgaccugcgggagacgcaguacaucgccaagaaggcgaaggagauccugcuacagaucaccagaagcguccuguccaccagcggcgggaucaccgaccgguuacgcgaggacugggaccugaucaacguaaugaaggagcucaaccuccccaaguaccgagcgcugggccugacgaagauggaggaccgcaaguacggccagcaggucgaggugaucacagacuggaccaagagaaacgaccuccgccaccacgcuauggacgcccugaccguggccuucacgaagcacaaccacauccaguaccugaacuaccucaacgcgcggaagaacgagaaacacaaggagcauaacaacaucauggccauccagcagcuggagaccauaaaggugaccgacgagaacggcaacgagaagcgcaucuuuaaagccccgaugcccaacuuccggcaggucgccaaggccuuccuggagaacgugcucaucucccacaaggcgaaaaacaagguggucaccaagaauaagaacaagaucagcgggaacaacaaggugcaggaggugcucacgccgcgcggccagcugcacaaggagaccaucuacggcaaguaccaguacuacguccagaaggaggagaagaucgggggcaaguuugaccucgagaccaucgagaagguggccaacccccuguaccagucccugcucaagaagcggcuggaggagaacgggggcgacccgaagaaggccuucaccgggaagaacagcuuagccaagaaccccaucuaccucgaugaggcccagacggagcagcugcccgagaaggugaaacuggucuggcucgagaacaguuucuccauccgcaaggacaucacccccgagaacuucaaggacgagaagcugaucgacaagauccuggaugagggcgugaagcggauacucaaggagcgcuugcagagcuucggcaacgacgcgaagaaggccuucuccgacuuggagaagaacccgaucuggcucaacaaggagaaggggaucgcuaucaagcgggugacuaucagcggcgucgccaacgccgagccccugcauaccaagaaggaccaucuggggaaggagauccucgacaaggaaggcaagcccauaccgguggacuucaucuccacggggagcaaccaccacguggcggucuaccgcgacgagaagggcaaccuacaagagaagguggugucugucuucgaggccguggugcgggccaaccagggccugcccaucaucgacaaaaccuacaaccaguaccucgggugggaguucuuauuuagcaugaagcagaacgagauguuugucuucccgaacgaguccaccgguuuuaaccccaacgacaucgaccugcuggacccgaagaacaagaaaauuaucagccccaaccucuuccgcgugcaaaagcuggccaccggggacuacugguuccggcaccaccuggagacgaccguggagaccaaaagcgcgaccaaggacaugacguacaagcgccuaagccugaaccacaucaagaauaucaucaagguacgcaucaaucaccucggcgacaucgucuccgucggggaguacuga

SEQ ID NO: 8017 - RNA, 4353 nt, Artificial Sequence
  Cas9 variant
augaagcacauccugggccucgaccuggggagcaacuccaucggcugggccuucgugcagcaggacuucgagaacaagcaggggaagaucaucgccaccgggagccgcaucauccccauggaccaagggauccugggcgacuucgagcggggcaacaccgucucccagacggcggagcgcacgaccuaccggaacacacgccggcuccgcgagcggcaccuccugcgccgggagcgccuccaccgggugcugcacauccugggguuccucccgccccacuacgacagccagaucgacuucaccaagcgcuacggcaaguucauugacaacgccgagcccaagaucgcguacaacaacgggaacuuuaucuucaugaacucuuucaacgagaugaucgaggauuucaagaaguaccaaccccaacuauucuauaagaaguccaacggcgaggaguccaagaucccguacgacuggaccaucuacuaccugcggaagaaagcccucagccagaagaucacccagcaggagcuggcguggcugauccuacacuucaaccaaaagcgcgguuacuaccagcugcggggcgaggaggagacagagaaccccaacaaggagguggcguuccacucccuggaggucguggacguggaagccgaggccccuaauaagaagggcgagaucugguacacgaucagacucgagaacgguuggauauaccggcgcaccagcaagaucccccuggacgacuggaagggcaagacccgggacuucaucgucaccacggaccugaacgacgacgggaccaucaagcucgacaaagagggcaaagagaagcgcuccuucagggccccggacgagaacgacuggaaccugcugaagaagaagacggagcacgacaucgacuucagcggcaagaccgugggcgcguacauauacgaccaccuucugcagaaccccaaccagaaaaucaagggcaagcugguucgcacgaucgagcgcaaguacuacaaggacgagcucaaggccauccuggccaagcagauagcccugcaacccgagcuguucaccgaaacccugcuggcugacugcauucgggagcuauaccgcaagaacgagacccagcagcagaacuuauuguccaaggauuuccuccaccuguucguagaggacaucaucuuuuaccagcgaccacuacgcagcaagaagucaacgaucgcgaacugcacccucgagaagcggagcuacaucgacaaggagaccaacgagcgcaaggacaccccgaucaaggugugcgccaaguccaaccccuacuaccaggaguuccgggugcuacaguggcugcagaaccucaggaucuacgagaucgagaccgaccgggaggucaccgccgaguucaucgagaccgcccaggacaaugaggcacuguucaacuuucugaugagccagaaggagaucgacaacgagucccuccuuaaguacuuccuauucgcgaagaacccccagaucaaggacaagguggccaagagcgagcucaagaaguggcugacaacguaccgcuggaacuacguguacgacgccgccgacaacagcuccaagaaguaccccaugaacgagaccggauacgagcugcagcaguaccugcagaagguagagggccucccggccaacuuccugaccuucgacaucaccuaccgguuguggcacuugcuguacagcgugaaggacaagguggaguucgagaaggcgcugaagaaguucgcccaggaguaccagcuggacgaggccuccuucgucgacagcuucaaaaacuucaagcccuaccccaaugaauacggguccuucagcgagaaggccauuaagaagcugcugccccucaugcgcuucggcaaccacugggacuucaaccggaucgacguguccacgcagaagcgcaucgacgaccugaucaacggcguggcuaaugacgagauccggacaaucauccgcgagaaggcggaaaaguaccagcugaacagcgaaaccugcuuccaggggcucccgcuguggcuggcccaauacgucgucuacaaucgccacgccgaggccgcggauaucgagaaguggaccuccgugaacgaccucgaggccuaccuggaggacuucaagcagcauagccuccgcaaccccaucgucgagcaggucaucacggagacccuccggguggugcgcgacaucuggcagcgcuacggcgggggccaggccaacuucuucgacgagauccacaucgagcuggggcgggaacugaagaagaccgcugaagaacgcaagcagcucuccaaccguaaccaggagaacgagaacaccaaccuucguaucaagaagcugcucgccgaacugaaggaggacgcgagcauccagaacgugcggcccuacucccccguccagcaggagcugcuaaagaucuacgaggagggcguguucuccgccaccgacgagguggaggaggacauccagaagaucagaaagaaggccgagccgacaacacccgagauccagcgguacaagcuguggcuggagcagaaguacaaguccccuuacaccggcgaagucaucagucuuaccaagcuguucacggaggaguacgagaucgagcacaucaucccccagucccgcuacuacgacgauagccucaguaacaaggugaucugcgagagcgccgugaacaagcucaagaccaaccagcuggggcuggaguucauccagaaccaccacggcgagaagguccguaucacggccaacaaggaggugaccaucuucacggaggaacaguacaaggaguucgugaagaagcacuacgcgaacaacagcgccaagcagcagaagcuccugcugaacgagaucccagagaagauggucgcccgccagcucaacgacacccgguacaucuccaaguacauuagcgagauccuguccaagauugugcgcucagacgagaaagacgaaggggugaacuccaagaacauaauccccugcaccggcaagaucaccacggcccugaaacaggacugggggcucaacgacgucuggaacgagcugauccugccccgguucgaacguaugaaccagcucacccagacccagcuguucaccagcuacaacgaccgcuuccagaagaaccugccgacggugcccaucgaguauucccagggcuuccagaagaagcgcaucgaccaccggcaccacgccauggacgcgcucgugaucgccugcgccacccgcgagcacaucaacuauaugaacaaccagcacgcccuggacaagagcaaggacaaaaaggagaagcagcagucccggauagacuugcgcaccaucuuaugcgagaagaagaacaacaacuggcaguucaagaagcccuggagcaccuucacgcaggaggcgcaggaggcccuggaacacaucgucguguccuucaagcagaaccugcgggugaucaacaaggccaccaacuacuacgagaaaugggaggagaaaaacggcguccucgugaaaaagaaggugaagcaggaggggaccaauugggccauccgcaagccccugcacaaggagaccgucagcggcaaaaucgugcuggaucgcaagaucgggaaggacaagauccucacggccacccggaagucuguggacaucaccuucaccgaaaagaucaucagcuccaucacggacaccggcauccagaagauccugcugaacuaccucaaguacaagggcagcccggaaguggcguucuccgccgaaggacuggaggaacugaacaagaacaucgcacaguacaacgacgggaagaagcaccagcccaucuacaaggugaggaucuucgaggaagggagcaaguucccacucggcgagaccggggccaaagccaccaaauacguggaggcggccaagggcaccaaucuguucuucggcgucuaccaggggaagggcaagcggaccuacgccaccaucccccugaacgaggugaucgagcgucaaaagcaggggcucccuagcguacccgaacggaacgagaaaggcgagcccuuacuguucucccucagcccuaacgaccuggucuacgugccgauggagggggagaucgccgagaccaucgacuucaacaaccuguccaaggaacagaaggagcgcaucuacaagacggucagcuucaccggcaaccagugcuucuucguacaggaggccguggcgacccccaucgugaacaagaucgaauauagcccccucaacaagauggagcgggauauccugggcaccaugaucaaggaggucugcaucaagcugaagguggaccgccucgggaacaucaccaaggccuga

SEQ ID NO: 8018 - RNA, 4353 nt, Artificial Sequence
  Cas9 variant
augaagcgcauauugggccucgacuuggggagcaacuccaucggcugggccuucguggagcaggacuucgaaaacaagcaggggaaaaucaucgccaccggcagccgaaucauccccauggaccaggggauccugggcgacuucgagaagggcaacaccgucucccagacggcggagcgcaccaccuaccggagcaugcgcagacuccgcgagcggcaccuccugagacgggagaggcuccaccgggugcugcacauccugggguuccucccgccccacuacgacgcccagaucgacuucacgaaacgcuacggcaaguucaucgacaacgccgagcccaagaucgccuacaacaacgggaacuucaucuucaugaacuccuucaacgagaugaucgaggacuucaagaaguaccagccccaacuguucuacaagaaguccaacggcgaagagagcaagaucccguacgacuggacgauauacuacuuacggaagaaggugcucagccagaagauaacgcagcaggagcuggccuggcugauucuccacuucaaccaaaagcgcggguacuaccagcugcggggcgaagaggagacggagaaccccaacaaggaagucgcuuuccacucccugaaggugguagacgucgaggccgaggccccgaacaaaaagggggagaucugguacaccauacgcuuagagaacggguggaucuaucggcgcacgagcaagauaccccuggacgacuggaagggcaagacccgggacuucaucgugacgaccgaccugaacgacgacgggacgaucaaaguggauaaggagggcaaggagaagcgcuccuuccgggccccggacgagaacgacuggaaccuccugaagaagaagaccgagcacgacaucgacuucagcggcaagaccgucggggcguacaucuacgaccaccuccuccagaaccccaaccaaaagaucaaggguaagcuggugcgcaccaucgagcgaaaguacuauaaggacgagcugaaggccauccucgccaagcagaucgcacugcagcccgagcuguucacggagacccuccuggccgacugcauccgggagcuguaccgcaagaacgaaacccagcagcagaaccuccuguccaaggacuuccugcaccucuucguggaggacaucaucuucuaccagcggccccugcgcagcaagaaauccaccaucgcgaacugcacccuggagaagcggagcuacaucgacaaggagaccaacgagcgcaaggacaccuucaucaaggucugcgccaaguccaacccguauuaccaagaguuccgggugcuccaguggcugcagaaccugcgcaucuacgaaaucgagaccgaccgggaggugacggccgaguucaucgagaccgcagaggacuacgaggcccucuucaacuuccugaugucgcagaaggagauugacaacgaggggcugcucaaauacuuccuguucgcgaagaacccccagaucaaggacaaggucgccaaguccgagcugaagaaguggcucaccaccuaccgcuggaacuauguguacgacgccgccgacaacagcagcaagaaguaccccaugaacgagacgggcuacgaccugcaacgguaccugcagaagguggaggggcugcccgcaaacuuccucaccuucgacaucaccuaucgccuguggcaucucuuauauuccgucaaggacaagguggaguucgagaaggcgcucaagaaguucgcccaggaguaccagcuggacgaggccagcuucguggacuccuucaagaacuucaagccguaccccaacgaguacggcagcuucuccgagaaggcgaucaagaagcuccugccccugaugagauucggcaaccacugggacuucaaccgcaucgacgucagcacccagaaacgcaucgacgaccucaucaacgggguugccaacgacgaaauccgcacuaucauccgugagaaggcggagaaguaccagcugaacuccgagagcugcuuccagggacugccccucuggcuggcccaguacguggucuacaaccgccacgccgaggccaccgacaucgagaaguggaccuccgugagcgaucuggagaccuaccucgaggacuucaagcagcacucccuacggaacccgaucgucgaacaggucgugacggagacccugcgcguggugcgcgacauauggcagcaguacgggggcgggcaggcgaacuucuucgacgagauccacaucgagcucggccgggagcugaagaagaccgccgaggagagaaagcagcugagcaaccggaaccaagaaaacgagaacaccaaccuccgcaucaaaaagcugcuggccgagcuuaaagaggacgccuccauccagaacgugcggcccuacagccccguccagcaggagcugcugaagaucuacgaggagggcguguucuccagcaccgaccaaguggaggaggacauccagaagauacgcaagaaggccgagccgacgacgcccgagauccagcgguacaagcucuggcuggagcagaaguacaagucccccuacaccggggaggucaucagccugacaaaacuguucacagaggaguacgagaucgagcacaucaucccccagucccgcuacuacgacgacucccugagcaauaaggugaucugcgagucggcggugaacaagcugaagacuaaccagcucggccuggaguucauccagaaccaccacggagagaaaguccggaucaccggaaacaaagaggucaccauuuucacggaggagcaguacaaggaguucgugaagaagcacuacgccaacaacagcgccaagcagcagaaacuuuuacugaacgagauucccgagaagauggucgcacgccagcugaacgacacccgguauaucuccaaguacaucagcgagauccucuccaagaucguccgcucugacgagaaggacgagggggucaacuccaagaacguaaucccgugcaccggaaagaucaccaccgcccugaagcaggacuggggcuuaaacgacguguggaacgagcucauccugccccgguucgagcgcaugaaccagcuaacccagacccagcuguucaccagcuacaacgaccgguuccagaagaaccugcccacggugccgauagaguacagccagggguuccagaagaagcgcauagaccaccggcaucacgcgauggacgcccuagucaucgcaugcgccacccgcgaacacaucaacuacaugaacaaccaacacgcccucgacaagaacaaggacaagaaggagaagcagcagagccggaucgaccugcgcacaauccugugcgaaaagaagaacaacaacuggcaguucaagaagccgugguccaccuucacgcaggagaccaaggaagcgcucgagcacaucguggugucguucaagcagaaccuccgggucaucaacaaggccaccaacuacuaugagaagugggaggagaagaacggugugcuggugaagaagaaggucaagcaggaggggaccaacugggccauccgcaagccccuccauaaggagacagugucuggcaagaucgugcuggaccgaaagaucgguaaggacaagauccugaccgccacccggaaggaggucgacaucaccuucacggagaagaucaucucauccaucaccgacaccgggauccaaaagauccuccugaacuaccugaauuacaagggcagccccgagguggcguucucagccgaggggcucgaggaacugaacaagaacaucgcccaguacaacgacggcaagaagcaccagccaaucuacaaggugcggaucuucgaggaggggagcaaguucccccugggcgagaccggcgcaaaagcgacgaaguucgucgaggcggccaaggggaccaaccucuucuuuggcguguaccaggggaaagagaagcggagcuacgccacaaucccgcuaaacgaggugaucgagcgccagaagcagggacugcccuccgucccggaacggaacgagaagggugagccccuccuguucagccugagcccuaacgaccucguguaugugcccauggagggcgagaucgccgagaccaucgacuucaacaaccugagcaaggagcagaaggaacgcaucuacaagacggucuccuucaccggcaaccagugcuucuucgugcaggaggccguggcgaccccgaucgucaacaagauggaguacagcccccugaacaagauggagcgggacauccucgggacuaugaucaaggaggugugcaucaagcugaagguugaucgacuuggcaacaucaccaaggccuga

SEQ ID NO: 8019 - RNA, 4353 nt, Artificial Sequence
  Cas9 variant
augaagcacauucuuggccucgaccuggggagcaacuccaucgggugggccuucgugcagcaggacuucgagaacaagcaaggaaagaucaucgccgcgggcagcaggauaauccccauggaccagaagaugcuguccaacuucgaagaggggaccacugucagccagacggccgagcguaccaccuaccgcuccaugaggcgccuccgugagcgacaccuucugcggcgcgagcggcuccacagggugcugcacauccuaggcuuccucccgccccauuacgacgcccaaaucgacuucaccaagcgguacggcaaguucauugacaaugcggaacccaagaucgcauacaacaacgggaacuucaucuucaugaacagcuuuaacgagaugaucgaagacuucaaagagcaccagccccaacucuucuacaagaaguccaauggggaagagagcaagaucccauacgacuggacgaucuacuaucugcgcaagaaagcgcucucgcagaagaucacccaacaggaguuggccuggcugauucuccacuucaaccagaagcguggguacuaccagcugcgcggcgaggaggagaccgagaaccccaauaaggagguggccuuccacagccugaaagucguggacguggaggccgaggcgcccaacaaaaagggugagaucugguacaccauccggcuagaaaacggcuggaucuaccgccggacgucuaaaaucccacuggacgacuggaagggcaaaacccgcgacuuuaucgucaccaccgaccugaacgacgacgggaccaucaagcucgacaaggaggguaaggagaagaggagcuuccgcgccccggacgagaacgacuggaaccugcuaaagaagaagaccgagcacgacaucgacuucuccgggaagcccgugggaaccuauauauacgaccaccuccugcagaacccgaaccagaagaucaaggggaagcuaguacggaccaucgagcgcaaguacuacaaggacgagcucaaggccauccuggccaagcagaucgcccugcagccugagcuguucacugagacccugcuagcggacugcauccgcgaguuauaccggaagaacgagacccagcagcagaaccuacuaagcaaggauuuccuccaccuguucguugaggacauaaucuuuuaccaacggccgcuuagguccaagaaguccacaaucgccaacugcacgcucgagaagcgcuccuacaucgauaaggagaccaacgagcgaaaggauacccccauaaagguguguagcaaguccaaccccuacuaccaggaguuccgcgugcugcaguggcuccagaaccucaggaucuacgagaucgagaccgaccgcgagguaacggccgaguucaucgagaccgcccaggacuacgaggcgcuuuucaacuuccucaugagccagaaggagaucgacaacgagagccuccugaaguacuuccuguucgcgaagaacccccagaucaaggacaagaccgccaagauagagcucaagaaauggaucaccacguaccgguggaacuacguguacgacguggccgacaacuccagcaaaaaguacccgaugaacgagaccggguaugaccugcagcgcuacaugcagaaggucgagggccugcccaccaacuuccugaccuuugacacgacauaccggcucuggcaccuccuguacucagugaaggacaagguggaguucgaaaaggcccucaagaaguucgcuaagaagaagcagcuagacaaaaccuccuucgucgacuccuuuaagaauuucaagcccuaccccaacgaauacgggagcuucuccgagaaggcgauaaagaaacuuuugccgcugaugcgguuuggcaaccacugggacuucaaccguauagacgugaguacgcaaaaacguaucgacgaucugauaaacgggguggccaacgaggacauacggacgaucauucgcgagaaggccgagaaauaccagcucaacuccgaaaccugcuuccaggaccugccccuguggcucgcccaguacgucguguacaacaggcacgccgaggcgacagauaucgagaaguggaccagcguauccgaccuggaggccuaccuggaggacuuuaagcaacacagccuccgcaaccccaucgucgagcaggucgugaccgagacgcugcggguggugcgcgacaucuggcagcaguacggcggcgggcaggccaacuucuucgacgagauccacaucgaguuaggccgcgagcucaagaagaccgccgaggagcggaagcagcuuucagacaagaaccaggagaacgagaacaccaaccugcgcaucaagaagcuccuggcggaacugaaggaggaugccagcauccagaacguccggcccuacuccuuggugcaacaggagcugcugaagaucuaugaggaggggguguucagcuccaccgacgaaaucgaggaggacauccagaagaucaggaagaaggucgagccgacgacccccgagauccagcgguacaagcucuggcuggagcagaaguacaagagccccuacaccggcgaggugaucaguuuaaccaagcuguucacggaggaguacgagaucgagcacaucaucccccagucccgcuacuacgaugacucucugucaaacaaggugaucugcgaaagcgccgucaauaagcugaagaccaaucagcuaggguuggaguucauccagaaccaccacggcgagaaggugcggaucaccgccaacaaggaggugaccaucuucaccgaggagcaguacaaggaguucgucaagaagcacuaugcgaacaacucugcgaagcagcaaaagcugcuccugaacgagaucccggagaaaaugguggcucgccagcugaacgacacccgguauaucagcaaguacaucuccgagaucuugagcaagaucgugcgcuccgacgagaaggacgagggcgucaacagcaagaacaucaucccaugcacagggaagaucaccacggcccugaagcaggauuggggccugaaugacgucuggaacgagcucauacugcccagauuugagcgcaugaaccagcugacccagacccagcuguucaccuccuacaacgaccgucuucagaagaaccugccgacggugcccaucgaguacagccagggguuccagaagaagcgcaucgaucaccggcaucacgccauggacgcccucguuaucgccugugccacccgcgagcacauaaacuauaugaacaaccagcacgcacuggacaaguccaaagacaagaaggagaagcagcagagccggaucgauuugcgcacgauccuuugcgagaagaagaacaacaacuggcaguucaagaaacccuggcggacauucacgcaggaagccaaggaggcccuggagcacauaguggugucguucaagcagaaccugcgugugaucaacaaggcgacgaacuacuaugaaaaaugggaggagaagaacggcguacuuguuaagaagaagguaaagcaggaggggaccaauugggccauccggaagccucugcacgaggagaccuucagcggcaagaucucccugaaccgggagaaggugggcaaggggaauauccucacggccacccgcaaagccguggacagcuccuucgacgucaagaagaucagcaagaucaccgacaccggcauccagaaaauccugcucaauuaccucaaguacaaggguagcccggagguggcguucuccgcugaaggcuuagaggagcugaacaagaauauugcccaguacaacaauggcaagaagcaccagccaaucuacaaggugcgaaucuacgagaaggggagcggccgcuucguauugggggagaagggcacgaaauccaagaaguacgugcagggggcccccaaccuguacuucggcguguaccagggcaaagagaaacgcaccuacgccaccauccccuugaacgaggucaucgagcgccagaagcagggccuaccguccguccccgagcggaacgagaaaggcgagccccuucuauucucccucagucccaaugaccugguguaugucccgauggagggcgaggcgaccgaaacgaucaacuucaacaaccugaacaaggagcaaaaggagaggaucuacaagaccgucuccuucaccggcaaccagugcuucuucgugcaggaggccgucgcaagccccauugugaacaagauggaguacucuccccucaauaagauggagcggagcaucguggggauaaugaucaaggaagucugcaucaagcucaagguggaccgccuggguaacaucaccaaggccuga

SEQ ID NO: 8020 - RNA, 4362 nt, Artificial Sequence; identical to SEQ ID NO: 2220
  Cas9 variant

SEQ ID NO: 8021 - RNA, 4368 nt, Artificial Sequence; identical to SEQ ID NO: 2221
  Cas9 variant

SEQ ID NO: 8022 - RNA, 4374 nt, Artificial Sequence
  Cas9 variant
augaagaccauccugggcuuagaccuggguaccaacuccaucggcugggccaaaguguccgucgacgacuacgggaacuaccugcacgacauuaaacucggcagcagaaucauccccaugucccaggacguccuggggaacuucgacagcggcguuacggucucccagaccgcccagcgcaccgaguuccgaagcaagcggcgccuggugcagcggaaccuccagcgucgggagcgccugcaucgggugcuucacguucucgacuuccugccugcgcacuacgacgccgcaaucggcugggaccgcacagaggccgugacguacgggaaguuccugaaccaugccgagccuaagcuggcgugggaggagcugggcaacgggaagcggcgcuuccuguucauggacaguuuccacgagaugguggccgacuuugcccggugccagcccgcccucgucgcggacggaaagaagauccccuuagacuggaccaucuacuaccuccggaaaaaggcccucacucaggccaucacaaaggaggagcuggccuggauccuguuaaacuucaaccagaagaggggguacuaccaguuacgcggggaggaggaggaggagaaccccacgaagcaggaggaauacuacgaacugaagguggugagcgucgaggccaccgacucccggaagggcaacgauaccugguacaacgugcacuuggagaauggguggaucuaucgccggagcuccaagaucagccuggacgacugggugggcaaggucaagcaauuuaucgugacuacggaguacgagaaggacggggcgacccugaagaccgacaaggaaggcuaugugaagcgcucuuuccgggcgcccaacgaaaacgacuggggccuccgcaagaagagaaccgaaacgcugcuggagaugagcgggaagacggucggcgccuucaucuacgaucaccuccugcaggagcccgccgacaaaauucgggggaacuucauccgcaccaucgagcgucacuacuacaaggccgagcucgaggcgauccucgccgagcagugcaaauaccacaucgaauugcgcgacaaggaaaugcuggaggcaugcgcccgggagcucuaucugaacaaccugccccaccagcguucccucaugaagaaggacaugaccuaccuucugcucuacgaucugaucuuuuaucagcgaccguuaaagagcaaaaaggcccugaucgcgaauugccccuacgaguacuacgaauacguagacaaggagacgggugagaucaagagacagaacaucaagugcaucgccaaguccaacccguacuuccaggaguuccggcuguggcaauucguccugaaccuccgccuauucgaccgggucgaggacaaggaggugaccgcgaacuaccugcccaccgcggacgaccacgccagacuguucacguaccuaaacgaccggaaggagaucaaccaggagacgcugcugaaggacuacuucaagcucaagaaagugaagaucgggaacgagaaggaguacccgauccgcuggaauuacaucgaggacaaggagaagaaguacccuuguaacgagacccgguacgagcugcugauggcgcucgauagggccggcauagagcacaaguggcuggacgauaauaaccuggaguauaggcuguggcaucuccuguacagugucgaggugaaauccgaaagcgagaccgcccugcgcaaacugaagaacgacgaugccuucgucaacaguuuccugaagguaaaacccuucaagaaggaauacggcgcguacucugagaaggcgaucaagcggcuccuugcggugaugcgcaagggguuccuguggaacgagcaggauauaugcgacgagacccgcaagcggaucgagaucaucaucaagggcgacguggacgaaaaagugaaggagcgcauggggcaugccgccuacucuuucgaccggguuagcgacuuccagggacuccccgagugguuggcgugcuacgugguguacgggcgccacagcgaggccauggacauccagcacugggacuccccggagcggcugauggccuacauaaacaauuucaagcaguacagccucagaaaccccauuguggagcagugcauccuggagacccugcggacaguccacgacauauggaaggagacuggccagaucgacgagauacacguggagcucggccgcgagaugaaguccaccagcgaggagcgggcccgccggacgcagaacgugcugaggaacgagaacaccaaccugcggaucaagucccuccugaucgagcugaaaaacgacaccgacaucugcaacguccaccccuacagccccaugcagcaggagaucuuacgcaucuacgaagagggggcccugcaggagcugaaccgggaagacgaggacuucgaggagaucuccaagauaagccagaugucccagccgaguggaaaggagcucaaucgcuacaagcuguggcuggagcagaaauaucggucccccuacacagggaaggcgaucagccucgcaaagcuguucacgcccgccuaccagaucgagcacgugaucccccagagccgcuacuucgacgacagcuucacaaacaaagugaucugcgaagccgaggucaacacccugaagaguaaucuccugggcuacgaguucaucaagaagcaugggggcgagaucauccacugcacgaccuugggcgacguacggauuuucagcgaaagcgaguauaaggcguucgugauggaccacuacgcgaacaacaaguccaagaaggacaagcuccugauggaggacaucccgcaggaguuccugucucgccagaugaacgauucccgguacaucagcaaggucgugaagacgcucuuguccaauaucgugcgcauggccgacgagagcgaggccaccuccaagagcgucaucgugugcaccgggggcgucaccgaccgccugaagaaggacugggggcucaacgacgucuggaacucaaucguguauagccgguucgaacgccugaaucggcucaccggcaccgaggcguucggccacugggagaacaaggaugggaaacgcguguuccagaccuccaugccucucgagcugcagcggggcuuccgcaagaagaggaucgaucaucgacaccacgcgauggacgcccuggucauagccugcgccagccggaacaucgugaacuaccucaacaaugagucagccaacaaucccaaaaagcgggaggaccugcggcgccaguuaugcgauaagaaccgagugauucgcaagccgugggagaccuucacacaggacgcguacaacgcccucgagaacgucguggugagcuucaagaacuacgugcgggugaucaacaaggccaccaaccgcuacgagcacuacgacgagaacgggaagaaacgguucgugcagcagaagggcuccgagcucugggccauccgcaagccgaugcacaaggagacuuacuacggucacgucaaccuacggcgcaaggagcucgugacccugcagaaagcccuggacgacauccccuccaucugugacaaaaagcucagggacuacaucuccgcgcugguggaaaaacacuucaacaagcgacagcugcucgcccacuuuaagagcacggacuacuacuggcagaagcaguacgucaacaagguauauguguggacauucagcgacgauaucaaaccccugguggccacccgcaagcugcucgacaccaguuucgacgcgaagcggaucggcacgauaaccgacaccggcauccagaagauacugcgcaacuaccuggaggccaagggagggaacgcgacccucgccuucacgccagaggggaucgccgagaugaaccagaacaucagcaaguauaaugauggcaagccccaccagcccaucuugaagguaagaauaaccgaacccaugggggcgaaguaucgcgugggccagaccggcaacaagauggcgaaguacguggaggcccaguccggcaccaaucuguauuucgccaucuacgaggauagcgaggggaagagauccuacacgaccgugccgcuggacgagguggcagagcgccugaagcagcggcugagccccgugcccgagaaggacgaaaacgacgucccccucaaguucuaccuguccccgaacgaccugguuuacguccccaccgaggaggagcuacagcugcgcgaaugcaagcucaacaaggaucggaucuauaagaugguaagcuccacagggaacgagugccacuucauacccuacuacguggccaacgugaucuacaacaagggcggguucaacaugcagaugcaccgcccccagagcuga

SEQ ID NO: 8023 - RNA, 4374 nt, Artificial Sequence
  Cas9 variant
auggccaagauccugggccucgaccuggggaccaacagcaucggcugggccaucguggagaagaacaacuccgacuucacacugaucgacaaggggguccgcaucuucagcgaaggcgugaagacggagaaggggauugagcggucccgcgcggccgagcggaccggcuaccggucagcccggaagaucaaguaccgccgaaagcuacgcaaguacgaaacccugaagguccuguccaagaaccggaugugcccccuccagaucgaggacgucgaggccuggaagaaguccggcuucaaggacuacccacugauccccgaguuccugcaguggcuccgcaccaacgaccacgagaacgugaaccccuacuucuuccgggacaaggccucccgcgcgaaggugagccugugggagcuggggagggccuucuaccacaucgcccagcgccgaggcuuccucuccaaccgccuggaccagagcucugaggggguccuggaggagcacaacccccagauccagagccucaucgaggaccuggaggagacgucaaccauccugaacgagguacgggacuacuacaucaaccucggcuuacuggacggggugaagggggacuucaagaaggagcucgacgagggagagaagaaacuuaagagccuguacaacacccugaucgccaucaucaagaagaacgagaacgacguccagaagugcaaggacgagaucaucaagcgccuaaacaagaaggaggaccuggggaaggugaagggcaagaucaaggacaucucccaggcgaugcucgacgguaacuucaagacccugggacaguacuucuacucgcuguacaacaagggcaagauccggaaccaguacacgucccgugaggagcacuaccuccaggaguucaucaccaucugcaaggugcaggggaucaacggcaucaacgacgaggaaauccugccggagaagaaguucaccgggcuggcaaaggaccucuacaaggccaucuucuuccagcggccgcuaaagagccagaagggccugaucgggaagugcuccuucgagaaaaacaagagccgcugcgccaucagccaccccgacuucgaggaguaccgaauguggaacuaccugaacaccaucaaguucggcacgcaguccgacaagaagcugcgguuccugacccaggaggagaagcugaaacucauccccaaguuuuaccgcaaaaacgacuucaacuucgaggucuuagccaaggagcucaucgacaaaggcgcgaccuucggguucuacaagagcucccggaagaaugaguuccuguacugguucaacuacaagccgaccgacacggugagcgccugccaguucuccgcaagccugaagaacgcuaucggcgaggacuggcagaccaagguguucaccuacaagacccugaacagcgagaagaaggaagucaucaggacgguggacuaccgggaccuguggcaucuccugagcgccaguaccagcgacaucuaccuguacgaguacgcgaaggagaaacuugggcuggaggacaaguccgccaagaccuucagcaagaucaagcucaagaaggacuucgccucccugagccuguccgccaucaacaagauccuccccuacaucaaggagggccugcuguacagccacgccguguucauggcaaacaucgagaaggucguggacgagcacaucuggaaggacguuaaggagcgcaccaucauccaaaacgagaucuccaagaucaucaagagcgacgucuucgagcgggaggugaucaacaucaucaacgggcucaucaagaacuccaagacggagggcgagaacuacgccgaggagagcaagaacauuuucaagaccgaauuugacaacgccaucgccaagaucuucgagaagaacaacgacauagaguucaaccagccguuccuggacgauaccuaccucaaguacguggaggagcucaagaaguucgauaaggcccgcagcuuccugcccgucccgcgucuggacgagaaagugauccaguucuugcugggcaacaacaaggacgggauggucuacugcuccgacaagaacaagaccaagaagcuguaccauccaagcgauaucgagaucuucaagaagaagaucaucaaggacgaguuuggcaacgagaagauggugcucgggagcccccugacgaccagcaucaaaaaccccauggcgaugcgcgcccugcaccagcuccggaaggugcugaacacccugauccucgaggagcagaucgacgagaacacccgcauccacaucgagauggcccgggagcugaacgacgccaacaagcgcaaggggauccaggacuaccagaaugaaaacaagaaguuccgggaggacgcgaucaaggagaucaagaaacuguacuucgaggaaugcaagaaggaggucgagcccacggaggaggacgugcuccgcuaccaguuauggaucgagcaagacaaaaaggagaucuacgagcaggggaaguccauccggaucagcgacaucaucggcuccaacccggcguacgacaucgagcacacagugccccgcucgaucucccaaaacaacagucuaaugaauaagacccucugcacgccccgcuucaauagagagaucaagaagcagaagaugccgaucgagcuguccaacuacgaggagaucuugccccgcauugagcacuggaagaaggaggccgaagaccucacccggcagauugaaagcaucuccaaaagcaucaaguccgcgagcaccaaggaggccaaggacaaaaacauccgcaggaggcacuaccugacccuaaagcgggacuaucucaagggcaaguacgaccgcuucaucugggaggaacccaaggucggauucaagaacucccagauccccgacaccgggauaaucaccaaguacgcgcaggccuaccucaagagcuacuucaagcggguggagagcgucaagggcgguauggucgccgaguucagaaagcaguggggcauccaggaguccuacaucgacgagaacggguucaagcauuacaaggagaaggaccggagcaaacacacgcaccacaccaucgacgccauuaccaucgcaugcaugaccaaggacaaguaugacgugcuggcgcaggcauggaccuccgaggaugaacaggacaagcagaaggcaaagacccugaugagcgaggccaagccguggaagaccuucaaagaggacaucgagaagaucgaggaggagauacuggugucccacuucacccuggacaaugucaagaagcagagcaagaagaucgugagagugcggggcaagaagcaguacguagccgagaucgagcgagacgugaacgggaaggcgauggcgaagaaggacgcuaacggcaagaucauuuacaagcucaacgagaaaggggagaagaucccacggcugcagcagggcgauacgauccgcgggucccugcaccaggacagcaucuacggggccaucaagaacccccucaaccaggaggagaucaaguacgucauacggaaggaccuggagucccugaaggcgaacgacgucgacaacauuguggacgagaccgugaagcagaaggucaaggaggccaucgagaauaagauccuccugcugagcuccaacgcccagcagaagaacaagcucguggacgacguguggcugaacaaggagaagcaaguacccaucaagaaggugcgcaucuacgccaacagcgugaagaacccgcuggagaucaaggagcaaucccuccuguccaagucccggaaggagcacaagcagaaagucuacggccagaacgaugaaaacuacgcgauggcgaucuacgagcuggacgggaagcgcgaguucgagcucauaaacaacuucaaccuggcaaagcugaucaagcagaaagaaggcuucuacccgcucaacaaggagaaagaggugaaggggaagaaggugcuguaccccaucgccaagagcaacuaccgggacguagugcugaagcgcggccaacaggucguguucuacgacaaggagguggagaacccgaaggacauuuccgaggugaucgacuucaaaggcagaaucuacaucaucgaggggcucucgauccagcgcauaguccgcccguccgggaagaucgacgaguacggggugaucauguugaaguacuucaaagaggcccggaaggccgacgagaucaagaaggacaacuacaaacccgacggcguguucaagcugggggagaaccgccccacacggaagaugaaccacagccaauucaccgcguucgucgagggcaucgacuucaaagugcucccgacgggcaaguucgacaagaucuga

SEQ ID NO: 8024 - RNA, 4377 nt, Artificial Sequence; identical to SEQ ID NO: 2224
  Cas9 variant

SEQ ID NO: 8025 - RNA, 4377 nt, Artificial Sequence
  Cas9 variant
augaagaagauccugggccucgaccuggggaccaacagcaucggcugggcccugaucgagcaggacuucgaguccaaagccgggaagaucagcggcgcggggucccgaaucauccccaugagccaggacauccucggcaccuucgagacgggucaguccuacagccagaccgccgaucggacccacuaccgguccauccggcgccuguaccagcggaccaagcugcgcagggagcgcuuacaucggagccucaacgugcugggguuccucccggagcacuauaagaacgagaucgacuucgagcagcgcaagggccaguucuaccccaacaaggagcccaagaucgccuacuauccggagcagguugccuccaaggugaaauaccaguucuuguucaagagcuccuuccuggagaugguggaggacuucaagcgacgcggguacaacggcgccaucccguaugacuggacgaucuacuaccuccgcaaaaaggcgcuggaaaagaaaaucgagaaggaggaguuggccuggcuccugcugaacuuuaaucagaagagaggguacuaccagcuccggggcgaggaggaggacaccaacagcaacaagaaggaggaguucuacgagcugaaggucuccucuguggagcagacccacgacaccucccccagcggcacgugguauaacgugcaccuccagaacgggugggucuaucgccgaaaguccaaggacagccugaaggacugggagggccugaacaagaaguucaucgugaccacccaccugaacgccgacgggucagagaagcucgacaaggacggcaacgugagccgcagcuuccgggccccaaaagaagacgacuggggccuggucaagaagcgcacagaguccgugcuggaaaagucagggcuccacgugggcgaguuuauauacgagucucuguuggagaaccccgagcagaaaauccgggggagccucaucaagacgaucgagcgcaaguauuacaagaaggagcuggaggcgauccuggacaagcagaccuccuuccaucgcgagcuccggaacgacgcccuguacaaggaggcaacccuggagcucuacccgaagaacagcgcccaucgcuccaacaucaagcagcgggguuucaaauaccuguucauagaggacaucaucuucuaccaacgcccccucaagagccagaaacaccugaucgcacauugccaguacgagaaacggaccuacaagaacaacgggggcgagacgaucgaggucucccugcagggugcgcccaaaagccaccccuccuuccaggaguuccgcaucuggcaguucaucagcaaccugcgauucuacgacaaggaggagaucguggagggccaggagguguccaucacagagaagcuccucaagagcgacuccgacuucgccgagcuguaccacuggcugagccaucagcgcgaggucgaccagaacaagacccugaaauacuucacccagaagaagcugauccccaagcaaaagaaggacaaccccacgaucagauggaacuuccccgaggauaagaaguacgagaugggcgaguucaaggcccaguugcugucccgccuggagaaggugcggaacugccagcccgacaaguuccucacgcagaagaacgagcucgaccuguggcauaucauuuacagcgugaccgacaagaccgaguucgagaaggcccuggucacguucgccgagaagcgcgagcucgacuccgagagcuucguggagaacuucaagaaguucccgcccuucaagaacgacuacgcgagcuacucccugaaggccaucaagaagauccugccccucaugcggcgcgggaaguacuggaaggccgagaaccugggcccccaaaccuuacagcggaucgagaagauugugaacggggaggccgaugauaaaaucagcauccgcgcccggaagcucgcgcuucaccugaacgacaccaaauccuuccagggccucccuaccagccuggccugcuacguagccuacaaccgccacuccgagaacgaggagaaucagaaguggcagacccccagcgacaucgacaaguaccugaaggacuucaagcagcacucccuccggaaccccauuguggagcaacugaucaccgaggcccugcgagugguucgggacauauggaagcacuauggccaggggcagaaggacuucuucgacgagauucacguggagcucggccgggagaugaagaaucccgccaucaagcgaaagaagcugagccagaagauccaggagaacgaaaacacuaacuacagaauaaaggagguccugcgcaaucucaaggagaacaacaucgacgcgaagccguacagucccagccaccaggagauccugaagaucuacgaggaggggguguaccaguccaucgagaacguggaggaugagaucgagaaaauccggaagaacaacacccccagcuccaaggacaucaaccgcuacagacuauggcucgagcagggcuacaucagccccuacacaggggaggucaucccgcugucccaacuguucagcaaucaguacgagaucgagcacauaaucccccgcucccgguucuucgacgacagccucgccaacaaggugaucugcgagagcuccgugaacgcccugaaggacaacaagaccgcccuugaguucauuacaaaccacggcaacgagaagguagaguucgcgggcaagaccguggagauccucuccucggacaaguauacggagcacugcaagcgcuacuucaaacggaaccgcaccaagcugaagaaccugcuaagcuacgacgugcccgagggcuucaucaaccggcagcugaacgacucccgcuucaucagcaaguacguccgaaaccugcucuccaacaucguccgcgaggaggaggagcgggaggccaucagcaagcacauccuuacgaucccuggcuccaucaccagccagcugaagcaggacugggggcucaacgagaaguggaacgagguggucacacaccgcuucgagcggcugaacaaccugacgggcaccaccgacuucggcuucugggacaauaagauaaacgcguuucgcaucaccguacccaaggagcucuccaagggguuuaacaagaagcggaucgaccaccgccaccacacacuggacgcccuggugaucgccgcgugcacaaaggaccacgucaacuacauaaccagccuuaacaccgagcgcaauaaccacucccuggucagcaagcugcggaacacgaagaaggugcucaucaacggcaaggaacgccggaucgccaaggcauacaagcuccccugguccagcuucccccuggacgccaagcaccaguuggagaccacagucaucuccuucaagcagaaccugagagugaucaacaagaguuccaacaagaccuggcaauggcggaacgugaacggcgagcagaagaagaaguugaucccgcagaccaagggcgacagcugggccauacguaaauccaugcacaaggcgaccgucuccgccaagguggagagcguggggaagggcaagaucaaaaccaccaauaggacgccccucggcgagaucaagggggaaaaacacgucgagaagaucuacgaugccaggauccgcgaggugaucaucccuaaccaccugaacaaguaccuggacgagaagggcaagcccaacuacgaagccgcguucucccagagcgggauuaagcagcucaacgagaacaucgagguguuaaacgagggcaaaccgcacgcgcccaucuacaaggucccccucuucgaggucggguccaaguuccccgugagcgaggacgccaaguccccgaagaaccagaaguacgucgaggccgacaagggcacuaaccucuucuucgcuguguacuggaacgaggagaagcagaagcgcaacuucgagacggugcccuuacaccaggucaucgugcaccagaagcaaguagcgagccugcccaccgaacagcggacguccgugcccaucaaaccggagcucggccuguuccuguucagccucucccccaacgaccugguguacgugccgaccgaggaggagaucgaaaacccccaccuggucgaccucaaaaaccugagcaaagaccagaccaaccgcaucuacaaaaugguguccagcaccgggaacgagugccacuucaucccgcaccacaucucccgccuaaucaugaaguacaacgccaagcaaaaggugggcgaguucgggagccucaacaaggccgagaaggccaucacgggcgagaccaucaaagagaaaugccugaagauccagaucaacucccuggggaagcucaagaccgagcgcaucgccuga

SEQ ID NO: 8026 - RNA, 4380 nt, Artificial Sequence; identical to SEQ ID NO: 2226
  Cas9 variant

SEQ ID NO: 8027 - RNA, 4383 nt, Artificial Sequence; identical to SEQ ID NO: 2227
  Cas9 variant

SEQ ID NO: 8028 - RNA, 4389 nt, Artificial Sequence
  Cas9 variant
augaccaagaacauccucggccucgaccuggggaccaacagcaucggcugggcccugaucaagcagaacuucgagaacaagcagggagagauccuaggcauggggucccgcaucauccccaugagccaggacauccugggcgacuucggcaaggggaacuccgugagccagacggccgagcggaccaaguaucgcagcguccggcgccugcgcgagcgcuuccuccugcggcgcgagcggcugcaccgcgugcucaaccugcugaacuuccucccgcagcacuacgcgagccagaucgacuucgagaagcgguucggcaaguucaagguggagaccgagcccaagcuggccuggaagaacaucgacgggcaguucuccuuccuguuccagaccagcuucaacgagaugcucgaggacuuccgcgucaacggccaggacgugaagauccccuacgacuggacgaucuacuaccugcggaagaaggcccugucaaagaagauagagaaggaggagcucgccuggauccugcugaacuucaaccagaagcgcggguacuaccaacuccgcggggaggaggaggaggagaaccccaacaagcugguggaguucuacagccugaaggucguggacguggucgccgacgagccgcagaagggcaaguucgacaucugguacucccucauccuggagaacggguggguguaccggcggagcuccaagaucccccuguucgacuggaaggacaagacccgcgacuucaucgugaccaccgaccucaacgacgacggcagcaucaagaaggacaaggacgggaacgagaaacgguccuuccgcgcgcccagcgagaacgacuggacgcuggucaagaagaagaccgagcaggagaucgagcagucccggaagaccgugggcaccuacaucuacgaggcccugcucgacaaccccaagcagaagaucaagggcaagcuggugcgcacgaucgagcgcaaguucuacaaggaggagcugcggcagauccucgagaaacagaaggaguuccaccaggagcugcagagcgacgaccuguacaacgacugcguccgcgagcucuaccggaacaacgaggcccaccagcugacccuguccaagaaggacuucgugcaccuccugauggacgaccugauuuucuaccagcgcccgcuccggagccagaaguccagcgugagcaacugcacccuugaguuccgcaaguacaaggacgagaacggggccgagcacacccaguaccugaaggcgauccccaaguccaaccccuacuaccaggaguuccgucucuggcaguggaucuacaaccugaacaucuaccgccgggaggacgagcagaaccccaucacgggcgaguuucugagcaccacaaaggaguucgagaacuuguucgaguuccugaacacccggaaggaagucgaccagaaggcccugcugaagcacuucaagcucaacgacaagacgcacagguggaacuucguggaggacaagaaguacccgugcaacgagaccaagaccaugauauccagccgccuggagaagguggagaacaucucagacgacuuccugacccgggagaucgagcagaagaucuggcacaucaucuacagcgucaacgacaagaucgaguacgaaaaggcccucaaguccuucgccaagaagcaccaccuggacgagucuuccuucuuugaggccuuccgcaaguucccgcccuucaagagcgaguacggguccuucagcgagaaggcggucaagaagcugcucccacugaugcggcugggcaaguauuggaacuaugccgacaucgacaaguccagcaaggagcgcauccagaagaucaucuccggggaguacgacgaaaacaucaaggaccgggugcgcgagaaguccguccaccucacgaccgagaacgacuuccagggccugcagcuguggcucgcccaguacaucguguacggccggcacagcgaggccagcaugaucgggaaguggaacagcgccgacgaccuggaggaguuccugaagaacuucaagcagcacucccuccgcaaucccaucgucgagcaggucaucaccgagacccugcgcguggugaaggacaucuggcugaaguacggcaacggggcgaaggacuucuucaacgagauccacaucgagcugggccgggagaugaagcugcccgccaaggaacgcgaggaccugacgcggaagaucaccgagaacgagaacaccaaccuccgcaucaaggcccugcuggccgagaugaugaacgacagcuccguagagaacguacggcccuucagccccaugcagcaggagauccucaagaucuacgaggacgggguccugaacuccggcaucgagauugaggacgaguaccugaagaucagcaaaaccgcccagccgucccccagcgaccucaagcgcuacaagcuguggcuggagcagaaguacaagucccccuacacgggccagaucaucccccucaacaagcuguucaccccggaguacgagaucgagcauaucaucccccaaucucgguacuucgacgacuccuucagcaacaagaucaucugcgaguccgcggugaacaagcugaaggacaacuacauuggguugggcuucaucaagcaguucgggggaaccaucaucgagcuggguuucggcaaaagcgugaaggucuuugagaccgaggaguacgaggacuucgugaagaagcacuacgccaacaaucgcuccaagcggaacaagcugcuccuggaggacauccccgagaagaugaucgagcgccagaucaacgacacgcggcacaucagcaaguacaucuccggcgugcugagcaacaucguccgcaucgacgacgaccaggccaagaagaucaucgaggacgccgagauccucgcccggaaggagaucgacaaggacaaagcgaaugaaauucgccggaaggccaagagccuggccaccgacgacgggaucaauuccaagaacaucgugcccggcaacgggaagauuacgacccagcugaagcaggacuggggccucaacgacguguggaacgaccugauccugccacgcuucgagcggaugaaccagcucaccaacagcaaagacuucacggucuggaacgagaaccaccagaaguaccugcccaccgugcccaucgaguucuccaagggcuucagcaagaagcgcaucgaccaccggcaccacgcccuggacgcgcucgugaucgccugcgccaccaaggaccacgucaaccugcugaacaaccaguccgccaagagcgacaccaagcgcuacgaccucaagaagaagcugaugaaguucgagaaggugguguaccaccacacgcagaccgggaacaagaucgagcgggagaucccgaagcaguuccugaagcccugggagaacuucaccuucgacgccaaguacaaucucgagagcaucaucgucagcuucaagcagaaccugcgcgugaucaacaaggcgaccaacuacuacgagaaguacguggagaaggacgggacgaagaacaaggggcgcgucgagcagaccggcaccaacugggccauccggaagccgaugcacaaagacaccguguccgguaaggugaaccugcccugggucaaggugccgaagggcaagauccugacggccacccgcaagauccuggacaccucguucgaccugaaguccaucggcagcaucaccgacacggggauccagaagauccuccggaacuaccuggaguucaaaggcucccccgaacuggccuucagccccgaggggaucgaggacuuaaacaagaacaucgaaaaguacaacgacggcaagccccaccagccgaucaacaaggugcgcgucuuugagcugggcuccaaguuucaggugggccagaccggcaauaagaaggacaaguauguggaggccgcgaagggaacuaaccuguucuucgccgucuacgaggacaagaacggcaagcggucguacgagaccaucccccucaacgaggugaucgagcgccagaagcaggggcuguccguggucgaccugaagggcacuaaugacuucuaccucugccccaacgaccugguauacauacccagcgacgacgagcuggagaacaucaacaacaucgacuucaagaacaucgccaaggagaagaacgagcggaucuacaagguggucuccuucagcgguagccagaucuucuucgugcgccaggacaucgccaccuccaucgugaacaaggccgagcucagcacccugaacaagauggagcgggcgauggacggcuccaugaucaaggagagcugcgucaagcugaacguggaccgccucggcaacaucuccaaggccuga

SEQ ID NO: 8029 - RNA, 4401 nt, Artificial Sequence; identical to SEQ ID NO: 2229
  Cas9 variant

SEQ ID NO: 8030 - RNA, 4401 nt, Artificial Sequence
  Cas9 variant
augaagaacauacugggccucgaccucgggaccaacagcaucggcugggcccuggugaaggaggacuucgagaacaagcagggggagauccucggcuuaggcucccgcaucauccccaugagccaggacauucugggcgaguucggccgggggaacuccaucagccagaccgcggaccgcaccggcuacagagggguccggcggcuccgcgagcggcaccuccugcgccgggagcgccuccaccgugugcugaacauccuggguuuccucccgaaccacuacgcgaaggagaucgacuucaccaagcgccuggggaaguucauuaaccacgccgagcccaagcugucguucgacaaggaguucaucuucaaggacagcuucaacgagaugcucaaggacuuccagcagaaccagcccggcuucaucaucaacaagcacggcgaggaggcccuggugcccuacgacuggaccaucuacuaccuacgaaagaaggcccucacccagaagaucgacaaggaggaacuggccuggauucugcucaacuucaaccagaagcgcggguacuaccagcugcggggcgaggaggaggaggagaacacgaauaagcuggucgaguucuacucccucaagaucauagacgugaucgcggacaacgaggugaacaagaagggggaggucugguacagccugcaccuggagaacggcuggaucuaccgccgguccagcaagaucucccucguggacuggaaggacaaggugcgcgacuucaucgucaccaccgacgugaaugacgacggcagcgagaagcuggacaaggacgggguggucaagcgguccuuccgcgccccgucugccgacgacuggaccuuacucaagaagaagacggagcaggacaucgacaacuccaacaagaccgugggcgccuacauauacgagaaccugcugcuaaaccccaagcagaagaucaaggggaagcuggugcggaccaucgaacgcaaguucuacaaggacgagcugaagcagauccucgaaaagcagaaagaguuccaccaggaacugcagaacgagcagcugcuccaggacugcguccgcgagcuguacaaguacaacgagcagcaccagcagaugcuggagagcaaggacuucgugcaccucuuccugaacgacaucauuuucuaucagcggccccugcgcucccagaagucccucaucuccaacugcacccuggagaaacgggugagccgcgacggcgucguguuccccaucaaagugauuagcaaguccaacccguacuaccaggaguuccggcugcuccaguggcugcagaaccuggcgaucuaccgcaaggacgacgacgucaacgugacgcaggaguuucugaacagcaucgaguccugggagaaccuccuccaguuccugaacgccaagaaggagaucaagcaggagcagcucauaaaguuccugcuggagcaaaaggggcucaagggcaacagccugaagaccgccauccugaccuaccgguggaacuacgugaccgacaaggucuaccccaugaacgagacgcgcucccucauccaggacaagcugaaaaagguggagaacgucgccaccgacuuccugagcuucgacaacgagauggcccucuggcacaucaucuacuccgugaacgacaagaucgaguacgagaaggcgcuggccaaguucgccagcaagcacaaccuggaugagaucuccuucguggagagcuucaagaaguucccgcccuucaaguccgacuacggcagcuucucagagaaggccaucaagaagcuccugccucugaugcgguucgggucagucuggaacaagaacaacaucgugcccuccguguuagaccgcaucgacaagauccugaccggcgaguacgaugagaagaucaagauccggguccgcgagaaggccgagcaguuccaguugaaccagaucgaggacuuucagaaccucccccuguggcuggcgcaguacgugguguacgaccggcacagcgaggccgagaucgccgggaaguggaacuccgucaaggaccucgagaacuaccugaaggaguucaagcagcacucgcuacgcaaccccaucguggaacagauuaucaccgagacgcuccggguggucaaggacauauggcagcaguauggcaacggggugcagaacuucuucgacgagauacacaucgagcugggccgcgaaaugaagaacaccgccgacgagcggaagcgcaucaccaacuccgucaccgaaaacgagaacacgaaccugcggaucaaggcccuccugguggagcugaaggaggacaccaacaucgagaacgugcgcccgcacagccccaugcagcaggagauccucaagaucuacgaggagggcgugcuaaacgcggucgagaacaucgacgaggacauacugaagaucagcaagaccgcccagcccuccaagagcgagcucauccgcuacaagcuguggcuggagcagaaguaccagucccccuacaccggggagaugaucccgcucagccggcuguucacguccgacuacgagaucgagcacgugaucccccagagccgcuacuucgacgacucccugagcaacaaggugaucugugaggccgccgucaacaagcggaaggacaaccagcucggccuggaguucaucaagaaccaucacuccgaaaagaucgagcuggggaacggcagaaccgcacagguucucgagguggaggcguacgaguccuucgucaaaaagaacuacgacaagaaccgggggaagcgcaacaagcugcugcuugaggacgugcccgagaagaugaucgaaaggcagcugaacgacacccgcuacaucuccaaauucgugacccaccuccugagcaacaucguccggaaggacgaggugaacuccaaggacgacggcauaaacagcaagaacaucauccccggcaacgggaagaucacgucccagcugaagcaggacuggggacugaacgacguguggaaugagcucauccugccgcgcuucgagcggaugaacaaccugaccaacagcaccgacuucaccuccacgaacaccaacgggaagaucauccccaccgucccccucgaguacagcaagggcuucagcaagaagcgcaucgaccaccggcaccacgcccuggacgcccuggugaucgcccucgcgacccgggaccacgugaaccugcugaacaacgaguccgcccuccccaagaaggaccggaccaaggaggaacagaaguccuuucgcuucgaccugcaggucaaccugcggaacaaggagaaguacuucaaugugaaggagggccgcgagaaggagaaguucacgaccuucaagaagccguggaacacccucacacaggacacacgggacgcccuggagaacaugguggugagcuucaagcagaacuuacgcguaaucaacaaggcaaccaacuacuacgagagcuauacggacgagaacgggaaccuccggcuggacaaguacggcaaccccaagaaggagcugaucucccagaaggggaccaacugggccauccgcaaaagccuccacaaggagacgguguccggccagauccacuuagaccgcgucaaggugaccaaggggaagaucgugaccgcgacccgcaagagccuggacuccagcuucaacgagaaguccaucgagagcaucacggauaccggcauccagaagauccuccggaacuaccugaaggccaaggacaacaagcccgacgucgcuuucuccccggagggcaucgaggaacugaauaagagcaucuccguguauaacgaggggaagaaccaccagcccaucaucaaggugcggaucuucgagcagggcagcaaguuccccgucggggagaccggcaacaagaucgccaaguucguggaggccgcgaaggggaccaaccucuucuucggcaucuaccaggacaagacgggcaagcgcuccuacgauaccaucccccugaaccuggugaucgagcgguuaaagcagggccugagcccgguccccgagaccaacgagaagggccaccagcugcuguuccaccugucccccaacgaccugguguacgugcccaccaucgacgacaacgagcagcucgacagcaaccgcgucuacaaguucacggacagcuccgacacaaccugcaacuucaucccgucuaauaucuccgccaucaucuucaacaucaacagcaaggagcaggagaagcgggggaucaacuaccccauccagaacgagcugggcguggggagcccccagagcaagaaccagaaguccuucgacggcuucaugaucaaggaggucugcaucaaacucaagguggaccgccucggcaacaucagcaagaccuga

SEQ ID NO: 8031 - RNA, 4416 nt, Artificial Sequence
  Cas9 variant
auguguaaguacuucuacaucaagaacuucaucacauucgugcugagcaaguccaucauaccaaugaagcacauccucggucuggaccuggggagcaacucaaucggcugggccuucguccagcaggacuucgagaacaagcaggggaagaucaucgccaccggcagccgcaucaucccgauggaccaggggauccucggugauuuugagcggggcaacacugugucccagaccgcagagcgcaccaccuaccguagcacgcgccggcugcgcgagcggcaccuccuccgccgggagaggcugcaccggguacugcacauccucggcuuccugccuccccacuaugacgcucagaucgacuucaccaagcgcuacggcaaguucaucgacaacgccgaacccaagaucgcauacaacaaugggaacuucaucuucaugaacuccuucaacgagaugaucgaggacuucaaaaagcaccagccccagcuauucuacaagaagaguaacggcgaggagagcaagauccccuaugauuggaccauuuacuaucuccggaaaaaggcccugagccagaagauuacccagcaggagcucgccuggcuaauccugcacuucaaccaaaagcgcgguuacuaccagcugaggggcgaagaggagacggagaaccccaacaaggaggucgccuuccacucccucaaggugguggacgucgaggccgaggcucccaacaagaagggcgagaucugguacaccauccgccuggagaacggauggaucuaccggcggaccagcaagaucccgcuagacgacuggaagggcaagaccagagacuucauagugacgaccgaccucaacgaugacgggaccaucaagguugacaaggagggcaaggagaagcguucguuuagagcgcccgacgagaaugacuggaaucugcugaaaaagaaaaccgaacacgacaucgacuucagcggcaagacugucggggccuacauuuacgaucaccuccugcagaaccccaaccagaagaucaaaggcaaguuagugcggaccaucgagcgcaaguauuauaaggacgagcucaaggcaauccuggccaaacagaucgcccugcagccggagcuguucaccgagaccuugcuggcggacugcauacgggagcucuaccgcaagaacgagacgcagcagcagaaccugcuguccaaggacuuucuccaccuguucguggaggacaucaucuucuaccagcggccguugaggagcaagaaguccaccaucgccaacugcacccucgagaagcguagcuacaucgacaaggagaccaacgagcgcaaggacgccccaauaaaggucugcgccaaguccaaccccuacuaccaggaguuucgggugcugcaguggcuccagaaccuccgaaucuacgagaucgagacggaccgggaggugaccgccgaguucaucgagacgccccaggacugcgaggcgcuauucaacuuccugaugagccaaaaggagaucgacaacaaggggcuccucaaauacuuccuguucgccaagaacccgcaaaucaaggacaaggccgccaaaagcgagcucaagaaguggcugaccaccuaccgcuggaacuacgucuacgaugccgcggacaacuccagcaagaaguaccccaugaacgagaccggcuacgagcugcagagguaccugcagaagguggaaggacuccccgccaauuuccuaaccuuugacaucaccuaccagcuguggcaccuccuguacuccgugaaggacaaagucgaguucgagaaggcccugaagaaguucgccaaaaagaagcagcuggacaagacuagcuucguagauagcuucaagaacuucaagcccuacccgaaugaguauggcagcuucuccgaaaaagccaucaagaaguuacugccgcucaugcgcuuuggcaaucacugggacuucaaccggaucgacgugagcacccagaagcgcaucgaugaccugaucaacggggucgcgaacgaggacauucggaccauuauccgcgagaaggccgagaaguaccagcugaacuccgaaaccugcuuccaggaccucccccuguggcuggcccaguacgugguguacaaccggcacgccgaggcgacggacaucgagaaguggaccagcgucucugaucucgaggccuaccuggaggacuucaagcagcacagccugcgcaacccaaucguggagcaagucgugaccgagacccuccgggugguccgcgacauuuggcagcaguacggagggggccaggcgaacuucuucgacgagauccacauagaacugggucgcgagcugaagaagaccgccgaggagcggaagcaacuuuccgacaaaaaucaggaaaacgaaagcacgaaucugcgcauuaagaagcugcucgccgagcugaaggaggacgcgucgauacaaaacgugcggccguacagccugguccagcaagagcuccugaagauauacgaggagggcgucuucuccgccaccgaugaaguggaggaggacauccaaaagauacguaagaaggccgagcccagcaaagccgaccuccaacgguacaagcucuggcuggaacagaaguauaagucccccuacaccggggaggugaucucccugacaaagcuguucacggaggaguaugagaucgaacauaucaucccccagagccgcuacuacgaugacucccucagcaacaaggucaucugcgagucggccgugaauaagcugaagaccaaccagcucgggcuggaguucauccagaaccaccacggcgagaaagugcggaucacagcgaacaaggaggucacgaucuucacagaggagcaguacaaggaguucgugaagaagcauuacgccaacaacagcgccaagcagcagaagcugcuacuaaaugagaucccggagaagaugguggcccgccagcugaacgacacccgguacauauccaaguacaucucggagauccucuccaagaucgucagauccgacgagaaggaugaggggguuaacuccaagaacaucauucccugcaccggcaagauaaccacggcccugaaacaggacuggggccugaaugacguguggaacaagcucauccucccgcgauucgagcgcaugaaccagcuuacccagacccagcuguucaccucauacaacgaccggcuccagaagaaccugccgacgguccccaucgaauacagucagggcuuccagaagaaacgcaucgaccaccgccaccacgcgauggaugcccuggugaucgccugcgccacgcgugagcacaucaacuacaugaacaaccagcaugcgcuggacaagagcaaagacaagaaggagaagcagcagucucggauugaccugcgcacgauccucugcgagaagaagaacaacaacuggcaguucaaaaagcccuggaguaccuucacgcaggaggccaaggaggcccuggagcauaucgucgucuccuucaaacagaaccugagagugauaaauaaggccaccaacuacuacgagaagugggaggaaaagaacggcguacucgucaagaaaaagguaaaacaggaggggaccaacugggccauccgcaagccccugcacaaggagaccgugaguggcaagaucgucuuggaccggaagaucgggaaggauaagauccucacagcgacccgcaaggccguugacaucaccuucaccgaaaagaucaucuccagcaucacggacaccgggauccagaagauccugcugaacuaucucaaguacaagggcagcccugagguggccuucuccaccgaggggcuggaagaguuaaacaagaacauugcccaguacaacaacggcaaaaagcaccagccgauauacaagguccgcaucuucgaggaggggucgaaguucccccucggggaaaccggggccaaagcgacgaaguacguggaggccgccaagggcaccaaccuguucuucggcguguaccaggggaagggcaagcggaccuacgccaccaucccccugaacgaagucaucgagcgccaaaagcaggggcucccguccgucccagagaggaacgaaaagggcgagccccucuuauucagccucuccccgaacgaccuaguguacgucccgauggagggggagaucgccgaaacgaucgacuucaacaaccugagcaaggaacagaaggagcgcaucuacaagaccguguccuucaccggcaaccagugcuucuucgugcaggaggcggucgccacccccaucgugaacaagauggaguacagcccccucaacaaaauggagcgggacauccugggcaccaugauaaaggagguguguauuaagcugaaagucgaucgccucgggaacauuacgaaggccuga

SEQ ID NO: 8032 - RNA, 4416 nt, Artificial Sequence
  Cas9 variant
augggcuacaaggcgccccgcaacgacaaaggggagaucgacuacggcguggggcuggaccuagggaauggaucggucggcuggguggccauggacaaagacuaccaucugauccgggcccgcggacacgagcuuauuggggcccggcuguucgacccggcaaacucagccgagaaccggcgggaaucacgcaccacgcggcgacggcugucgcgccggcgcuggcggcuacgcaugcucgauucccuguucgccuccgaacuggcgaagauagacccgaauuuucucgccagaagaaaguacucgugggugcaccccaaagacgagcagaaccacgagaacugguacggcuccaucaucuucgggagcaaggagcaggacaagcaguucuacaaggacuaccccaccauauaucacuugcggaagaagcucaccgaggacaccgagcgccaugacauccgggagaucuauguugccauccaccauaucgugaaguaucgcggccacuuccucagggagggggaaaucaacagugaaaaccuguuugacccagagggcuucguggaauugaucaaggacgucaucaagcugaacaacucguacgacgaauccacccccauauucgaggccagccccgccgacguuuccgaggcgcugcugaacgagcacacgagccgcuccggacgcaucgaggauacccucgacaagcuagauuucagcgugucccgggucgacaaacaugagcugaaaggaaugcgcgacgcggcuaaggccguaaucggcgcgaucgucgggaacaccgccgauuucagcaaaaucuucaaucucgauaauuuggacaaggacuccaaggacaaccugaagcuaaaguucgccgauaguaacuucgacgagaaguacggcggagucguuggcucgggauugcuggacgagacccagaucgaacucguggaccgaauccacgccguauacgacgccguggcgcugaaagggauccugggcgaugcucauacuaucuccgaggccaagguagaguccuacgaaaaacaccgcaaaaacuggaagcucaucaaggaggagcugcggaccaaggaaaacaaggaugagguggaccugugguacggggaccucaguggcaggcaguauaagaacccacccgaccccgagaagggcccggacgaaggcucgaagaaagacucccccauccgggacagugaccaaaagcagaaccugaucaaaaaggccaacgacuacuucacggagcugaucgacgacucgcagcucagugaggagcagaagaacugccugaagaaugacauuaacaacggccaacuguuccccgugcaacgcuccagcgacaacggggucauucccuaccaaauccaccucaacgaguugcggcggauuaucgagaaccagaaacaauacuaccccuuucuggccgagaccuucauccgcaagacggcggaagggaaguccuacgaggaaaauaagauuguagcccucuuaaaguuccgcguccccuacuacguggggccgcugguaagcaaggaggacauggaggagcacuccucuggcaacuccgccuaccacuggauggcccggaaccccggucgcggugaggccaucacacccuggaacuucgacgaggucguagacaaggaugagagcggcgcgcguuuuauuagccgccucaccgggacggauacguaccugcugggcgaacccacgcuuccgcagcacucacugcuguaugaggaguacauggugcuguccgaacuaaacaacgugcggcugaacguucgccagggaaaccacuggucugacaagaaccggcagcgccugagcuacaaacagaaggaguuccucaucgagaaucuguucaaagaacacaagaccguuacccggaagcgagccgaggauugccugaguagcaugggcugcggcgaggugcagcuguucgggcuguccgaugagaagaaguucgccucuuccuuaagcuccuacauaacgcucaagaaaauccucggcaaggccuucgucgaugacagcgguaacuccgcgauccuggagcgcaucaucgagguucagaccguguucgaggaccgggagccccucacgcaccaacugagccugaucgacucccuuaccgucgagcagcgaaagcagcuugccaagauccauuacacgggguggggcaagcugucucgcaaacuccucaccuccaagaaaggguccuacaagauccacucccaaaacgagauuaugagaacccagcacagcaucaucgacauaaugcgcggugacucccugaaccuaaucgagauaauccgcgauaagaagauuggaaucggcgaauggaucgacaacgagaaccuggaccgggagaccggugagagcgacgucucucgcuuagaguccguguucgaggggaucguuaugagcccccggguuaagcgcggcgugguccaggccgugcggguuaucgacgaccucgccaaggcuaucgguaacccgccccaacgcaucuuuauugagauggcggacgagguccaggcuucccaacggacgguaucacgcuuaucccggcugaaggcccucuacggcagccccucccugcagaaggaguucaacgaccugaaggacuugcgcaaaagucugaacgaaaccaaggacgcggaccugcaggaggaucgacuauaccuguacuacauacagcugggcaaagaccucuauacuggcaaagagauuaguaucgacagucuguccagcgccuacgacauugaccacaucgucccccaagcgcucacccaagacgacaguaucgacaacaggguacucguaagccgaaaagagaacgcccgcaaaacggacuccuaccuguacacccccgaccugaucaagaacaugcgaccgcucugggguaaacuguuggcagccgggcucaugagucagaagaaguacgacgcccugacucggguggacgacuucaaggacagagagaagcaacgguucguccagagauccuuaguggagacccggcagaucaugaaaaacgugucgacaauucuccgcaccuacuacggcgaagacacaaacgucgugaccuugaaauccagcaucacccacgauaugcggaaguaucugggguuuccguacaagaaucgcgacaucaacgacuaccaucacgcgcaagacgcccucugcaucagcgcggccggacaguucaugcugaaccggcauuucgucuccgggggcgaagucacggauggcgcaagcaacgccuacaacauguaccuggcagaguaccuccaagaguuucgcgacgccaaggcccggggcgagcgcaagcgguccacugcguucggcuucgugguggggucgauguccagcaaggacgacgagaagcgcaccgaucaccgaaccggcgagaucguauggagcgagacgaacgccgaguauuuacgcaaggugaugaacuacaagaagaugcugaucacacagaaggugggggacgucaagacgagagcucucuaugaugagacccgcuacgggcacaaggagagcuccgcaaagagcaucaaguucgacaacuuaaggcgcgacacgucccuguacgggggcuucagcggcgccuccaccgcguacaugaugcuuguggaguacaagaagaaaaacaagcuggugagcaucaccgcucaagaggccagccugcucgccguagccgaccagaagaacgacaccgugagcgugauggacgggauccuagcgucccacggcuuaaguggggccaagauccuccuccccaaaaucgucacggggcaacugcucgauuacuccgacgcccuggugacucuccaaagcgccagcgagcucaauacugcgagacaaauguggcugccacggaacgacuacaacgacaucgacaucauucugaaguccaaggacauagaggacgccgcccacaagcucgguuacgauucggacacugugcacguccugcgccgaauccagaagcuguucgaggccguuuuccgcguggcugagucccaguucccccuccaccaguugagcaaggaccagcaagaggaaauacugcgagauccacaaaacuauggauucggcuccgcggucaagcuccuagggggacugcucaaagccuugcacgccaacgccgagaauacuaauuuagccgggcucguaaaagugcugcacggugacaaggaauacagcgacgacggcaaggcgaaggaguucaagaaguuugguuuuagcccccgcuggagacgcaucucgaacccgaccggauucacgcugagugacucggacaccuucaucuaccaguccccgagugggauauucgagcagcgggucacggugaaagagcucaaggagaaggccgacaagcaaaaauga

SEQ ID NO: 8033 - RNA, 4422 nt, Artificial Sequence
  Cas9 variant
augaaaaacauccugggccucgaccuggggaccaacagcaucggcugggcccugaucgagaaggacaccgaucagaagaacgggaacauccucggcacgggaucccgcaucauccccaugucccaggacaucaaagacgaguucggcaaaggcaauuccaucagccagaccgccgaccggaccaaguuccgcuccgugcggcgccuccgggagcgccaccuccuccggcgcgaaaggcugcaccgcguccugaacgugcucggguuccugccgaagcacuacgcggaccagaucgacuucaagaagcggcugggcaagcucgugaacgagacggagccuaagcuggucuaugacaacaagaacuucaucuucaaaaagagcuuugaggccaugcugagcgacuucaaccagcaccagccccuccugcuggccgacgggaagaaggugcccuucgauuggacgaucuacuaucuccgcaagaaggcccugaccgagaagauugagaaggaggagcuggccuggcucauccugaacuuuaaccaaaagcggggcuacuaccagcugcgcggggaggaggaggaggagaacccgaacaagaugguggcguuccacagccuaaagaucguggaggugaucgccgaugagucccagaagggcaaggccgagacaugguacucgcuuauccuggagaacggcuggaucuaccggcgcuccagcaagacaccucucuaugacuggaaagggaaacagcgcgacuucaucgugaccaccgaccugaacgacgacggguccaucaagaccgacaaggagggucuggagaagcggagcuuccgagcccccgucgaggaugacuggacccucguuaagaagaagacggagcaggagaucaaccgcucccacaagaccgugggcacguacaucuacgagaaccugcugcaggaccccaagcagaagauuaagggcaaacucgucagaacuaucgagcgcgaguucuauaaggacgagcugaagaugaucuuaaagaaccagcagaaguuccacccggagcucaacgacgagcaccuguacaucaacugcgugcgcgagcuguaccgcaacaaccaggcacaccagacgauccucagcaagaaggacuucgugcacuuauucaucgacgacaucaucuucuaccagcgcccccugcggucccagaaguccuccaucagcaacugcacccucgaguuccgcaaguacaagaacgagaacgggaccgaccagaccgacuaccugaaggccaucccaaagagccacccccuguuccaggaguuccggcucuggcaguggaucuacaaucugggcaucuaccaaaaggaggaugacacgaacgucacagaugagcugaucaagaacaucgacggauaccaggaccucuucgacuuccugaacaacaagaaagagauccgccaggacauccugaucaaguuccugguggagcagaccggccucaaggggaagccgcuguccagcguggucgccaaguaucgguggaacuucguggaggacaagaucuacccgugcaacgagaccggcacgcagauccgcaccagacuggccaagguggagaacacacccgaggacuuccucacggccgagacggagaucaagcuguggcacaucaucuacuccgugaaugacaaagcggauuacgagaaggcccugaagaccuucgccgagaagcacaaccucgacacccacagcuuuguggagaacuucaagaaguucccgcccuucaaguccgaguacggcagcuucuccgagaaggccaucaagaaacugcugccccucauccgccuggggaaguacuggagcugggagaacaucgacaagaagacccaggagcggaucgagaagauacugacgggcgaguucgacgaggccaucaagucccgcgugagggacaaggcgauccaccucaccgaggaggaccacuuccaggggcugcagcuguggcucgccucuuacgucguguacggccgccacuccgaggccgauaaccuggacaaguggcacaccgucgccgaccuggaggacuaccuggccgaauuucggcagcacagccugcggaaucccaucgucgagcaggucaucaccgagacgcuacggguugugaaggacauauggcuccaguacgggcagggcgcgaaggacuucuucuccgagauccacaucgagcuggcccgcgagaugaagaacaccggcgacgagcggaagcgccugaccagccucgugaccgacaacgagaacaccaaccugcgcaucaagguccugcucuccgagcuguuaaacgacgggaacguggagaacgugcggcccuacagcccgaugcagcaggaggcccucaagaucuucgaagacggcguccugaacuccgacaucgagaucgaggacgacauccugaagaucagcaagauggcccagccuacgaacaccgaacucaagcgcuauaagcuguggcuggagcagaaguaccgguccccauacaccgggcaaaucaucccccucaaccgccuguucaccgccgacuacgagaucgagcacaucaucccgcagagccgguucuucgacgacucguucuccaauaagaucaucugcgagagcgcggugaaccagcugaaggacaagcagcucggccuggaguucaucaagaaccacuccggaacgaucgugaagcugggcaugggcaagaccgccaaaauccucgacgucgagagcuacaacgaguuugugaaagggaacuacaccaagaacaucuccaagcgcaacaaacugaugcuggaggagauccccgacaagaugaucgagcggcagcucaacgacacccgcuacaucagcaaguucaucaucuccgcccugagcaacaucgugcgguccgagagcaacgacgacggcuucaacuccaagaacguccugcccgggaacggcaagaucacgagccgccucaagcaggacuggggcaugaacgacaucuggaacgagcugauccuuccccgguucgagcggaugaacaagaucaccgacuccgccguauucaccgcauggaacgagaacaaucagaaguuucucccgaucgugccccuggaguucagcaagggguuccagaagaagcguaucgaccaccgccaccacgcccuggacgcccucgucauugccgccagcacccgggagcacaucaaccugcugaacaacgagcacgccaagagcgacaagcgcuucgaucucaaucggaagcugcgcaaguucgagaagguggcguacaaugaccccaagacgggcaagcggaucgagaaggaagugccgaccauuuuccugaagcccugggagaccuucaccgucgacgcgaagaacagccucgagagcauuaucgugucauucaaacagaaccugcgcgugaucaaccgggccacgaacuacuccgagagcuacaacgaugagaacggggcccugcgccucggcaaggacgggaacccccugaaggagaagauuaagcaguccaagggcgacuccugggcgauucgcaaacccaugcacaaggacuucguguacggcaaagugcaccuccagaacgucaagcugccgaaggacaaguucaucaccgccauccguaagucccuggacgucaccuucgaccugaagcgcaucgagacuaucacagacacugggauccagaagauccucaagaacuaccuucacagcaaggagaacaagguggagcuggccuucucccccgagggcaucgaggauaugaaccaacacaucgagcgguacaacgacgggaagaagcaccagcccauccacaaagugcgcgucuucgagaucggcagccgguucucacucggggagagcgguaacaaaaagaccaaguucguggaagcagccaagggcaccaacuuguucuucgcaguguaccaggacgacaacaaggggaagcgcaacuaugagacgaucccccugaacaucgucaucgagcggcagaagcucggccugcacuccgugccgaccgaggacgccaagggcgggaagcugcuguuccaccugagccccaaugacaugguguacguccccaccuccgaggagcuggaggacaaucuugccagcgugaacaucaagcgccugaacaccgcccagcggaagaggaucuacaagguggaaaaggcguccgguguagagugcuacuucauccggcaggacaucgccuaccugaucaagaacuaugacgccaagacgaagaucggcgagcuugaaagccagaacaagcugcagacgaccaugaccgacgaccgccugaagaucacggacguuugcgugaagcucaacaucgaccggcugggcucaaucgccgagaccuuccuggggaaccaguacggcgccagcaagaagaccuga

SEQ ID NO: 8034 - RNA, 4422 nt, Artificial Sequence; identical to SEQ ID NO: 2234
  Cas9 variant

SEQ ID NO: 8035 - RNA, 4425 nt, Artificial Sequence
  Cas9 variant
augaagaaaauccugggccuggaccuagguacgaacagcaucggcugggcccugauagaguccgacuuugagaagaagcaggggaagaucaacggccucggaagccgaauaauacccaugucccaggacauccugggcaaauucgacagcggcguguccaucagccagaccgcggagcggacguccuaccgcgggguccggcgccugaaccaaaggaaccuccugcgcagggagagacugcacagggugcucaacauccuggacuuccugccgaagcacuacagcaacgcgauugacuucgagaagaagcucggacaguucaaagagaacguggaggaaaagcugaacuacgcuaaaaaccagaucggacgccacgaguucaucuucauggacuccuucaaggagaugguaaaggaguucaagcagacccaaccccagcuguucuauaagcgggagaacggcaucgaaaccaagauccccuaugacuggacccucuacuaccugcgaaagaaagcccugagccaaaagaucaagaaggaggaguuggcauggaucauccugaacuucaaccagaagcggggguacuaucagcugcgcggcgaggaugugcucgacgagucuaagaucgaggacuucuacagcuugaagguugucgaggugcaggaaacggaggacaagaaugcccggggcaccugguauaacgugauccuggagaacgacugggucuacaagcgccagaguaaggaaucucucgacaacuggaucgggaagaacaaggaguuuaucgugaccaccaacaaggagaaggacggcucccugaagcuggacaaggcgggcaacgugaagcggaacuuucgcgccgucgacagcgagaaagacuggaucgccaucaaaaagaagacggaacaggauguggagaucuccaagcacaccgugggccaguacaucuacgagacccuauugcaaaacgccaagcagaagaucaagggcaagcuggucaagaccaucgagcggaaguucuauaaggaggaguucaucaagaucaucaaggagcagcuuaagcaccaccccgagcugcagagcaagacacuguaugagacuugcauccaggagcucuacccacgcaaugaagcucaccagaacaacaucaaguccaaaggguucgaguaccuguuuaccgacgacaucaucuucuaccagcggccccucaagaguaagaaauccaccaucagcggcugccaguacgagacgcgccucuucaagaagaccgugcugaacaaggucaccaacaaggagaacgagaucuggcagaaggagccccuuaaagccauaaguaagagucacccccucuuccaagaguuccgccuguggcaauuucugaagaacuuaaagaucuaccagaaggaagacgucaaggggaaucugaucgaccacgacaucaccagcgaccugcucaagacggaagcggacuggguagagcuguucgacuuccugaacaucaagaaggagauagagcagaagcaaaucauccaguucuucauuaacaacaagcagaucgagaaaggcaagaagaacaacuaccgguggaacuacguggaagacaaaaaguacccguguaacgagaccaagucccagcucaucagccgccugaagaaggucaagaaccuggaucugaaccucuucuucacgucggaaaccgagcugaagcuguggcacaucaucuacuccgugaaggacaagauccaguacgagaaggccaucaagaacuucgccauaaagaacaacaucgacauagauuccuucgucgagaacuucaaaagauucccgccguucaagaacgaguacgccgcguacagcgagaaggccaucaagcgccuccuuccccugaugcguaugggggaguacuggaacgaguccgagaucaagcaggaggucaaggaccgggccuacagcaucauagaacggcucaagggcaucgacuucaacaaggacaagauagacgaaaagauuacggacgacgacaucaagaagcagcugcucaaguccuucaucgacuuuaaggacaagaacccucucaagggacuuaacaccuaccaggcaugcuacuuaguauacaaccgccacagcgaggucaacuccaucgcguacuggaaguccccugacgacaucaacaaguaucucgagggguucaagcaacacucgcugcggaaccccaucguggagcagguagugaccgagacucugagaaccgugcgggacaucuggcaguauuacggcaaagggaaggccagcuucuucaacgagauccacguggagcucggccgugagaugaaaaacccagccuauaagcggaaggccucuaccaaccgcgucaccgagaacgagaacaccaaccaccggaucaaggagauucugaaagagcugcagaacgaagguguacaggaagucaagagcuacucucguaaccagcaggagauccucaagaucuacgaggagggcaucuaccaguccaucgacgugguggacgacgcuaucgaaaagauccggaagaauagcuccccgacgaaggcggagauuaucaaauacaagcuguggcuggagcagggcuacaccagccccuauacuggaaagaccauccccauguccaaacuguucacgaccgacuaccaaaucgagcacaucaucccccagagccuguacuucgacaacuccuugagcaacaagaucaucugcgaaagcgagguuaaucagcucaaggacaaccaaaccgccuacgaguucauaaagaagcauggcaccgagaaggucagccucgggaagaacaagaccguggagaucuucacgcuggagcaguacgagaagcacugcaaccaguacuucaagaagaacaagaacaagcucaagaaacugcuguccgaggagaucccggagggcuucauaaacaggcagcucaacgacagccgguacaucuccaaauucaucaaggggcugcugggaaaccucgugcgcgaggaggaugagcaggaggucaccaccaagcacaucgugccggugaccggcgcgaucacgagcaagcugaagcaggacuggggauuaaacgacaaguggaacgagcucgucgccagccgcuuucagcggcugaacaccaugaccaacaguaacaacuucggcuacugggacaccaagaucaacgccuuccgcguccaagugcccgacgagaucuccaagggguuuagcaagaagcggaucgaucaccgccaccacgcgcuggaugcgcucgucaucgcaugcugcacgcggaaccacauuaacuaccugaacgcccugaacgcggagaagaagaacuacggccuccgcgacuugcugcucaucaagaacgacaagaaccacuacaccaaguuuuucaagcaccccugggacggcuucccgguggaggcuaagagcgugcuggagaagaccaucaucuccuucaagcagaacacccgggucaucaacaagacgaacaacaagaccuggcagugggccgagaaggaggggcagcugaagaaggugcucgugaagcagaccaagggcgacaacugggccauccgcaagcccaugcacaaggagaccgucagcgggaagcugaacauccccacgcccaagggcaaaaucgccaccgcgucccgggugucacugagcgaaaucaagacccgcaagcaguuagacaagaucaccgacauaagcauacagaagauacuggagcggcaucucaacaacuaccucgacgauaaggggaaggagaaguucgaccucgccuucaacgccgacgggguggaggaacugaacaagaacaucaagguccucaacaagggcaagaaucaccagccgaucuauaaggugcgccuguacgagaucggguccagauucaaggugggcaacucuggaaacaagaaagacaaauacgucgaagccgccaagggcacgaaccuguucuucgcgauuuaucucaacgagaaggacaagaagcgcguguacgaaaccauaccccugaacgaggugaucgagcaccagaaacaggucuccaaccugcccaaaaacgagcggaccccggugcccgugaaccauaccaagggcaaauuccucuucucccugucuccgaacgaucucgucuacgugcccacggacgaggagaucgacaacccgagccucguaaacuuuaacaacuugaacaagaagcaggucgaaaagaucuacaagaccguguccugcagcaccuaccagugcuucuucguacacaacaccaucuccaagcccauccagaacaaagucgaguucagcgcccugaacaagauggaaaagagcaucgacggcaucaugaucaaggauagauguuggaagcucaagauggaccggcugggcaacaucaucagcgugauacgcuga

SEQ ID NO: 8036 - RNA, 4443 nt, Artificial Sequence
  Cas9 variant
augaagaccauccugggccucgaccuggggaccaacagcaucggcugggccaaggugugugucgacaacgaugggaacuaccugcgugacauuaagcucggcuccaggaucauacccaugucgcaggacacgcucgggaacuucgacaagggcgugaccgacuccccgaccgccgccaggaccggcuuccgcggggugcgucggauccgcgagcgggcccuccagcgccgggagcgccuccaccggguccugcacgugaugaaguuccugccgccccacuaugagaacgcgauuggcuggaaucgcgaggaggccaccaccuacggaaaauucuuaaaccacggcgagccaaaacuggccugggagaagcaggaggacgggucuaugcgauuccuguucauggacuccuuucacgagaugauggcggauuucgccgagagccagcccggccugguugccggagggaagaaaauuccacucgacuggacccuuuacuaccuccgcaagaaggcccuaacccaggcgauccggaaggaggaacuagccuggauccuccucaacuucaaccagaaacgcggauacuaccagcugcgcggggaggaagacgaggagaaccccgccaagagggaggaguaccacgagcucaaggucgugucaguagaggccgcagaagagggcaaaggcgggaacacgugguacaacgucacccuggagaauggcuggaucuaccggcgccaaagcaagguggagcugcacgacuggguggggaagacccggcaguucaucgucaccacggaauacgagaaagacggagugaccaucaagaaggacaagaacggggaaguuaagcgguccuuucgcgcccccagcgaggaugacuggggccucagaaagaagcgcaccgagucccuguuagaggauagcggcaaaacggucggcgccuucaucuacgaccacauauuguccgagccgacggauaagauccggggcaacuucauccguaccaucgagcggaaguacuauaagaaggagcuggaggccauucugcucgagcagaccaagcaccacaaggaacugaaggaccagaacacccugaucgcaugcaucaaagagcuauaccagagcaauaagccccaccaggacucccugaugaagaaggacaugacguaucugcucaucaccgacuuaaucuucuaucaaaggccccucaagagcaagaagucccucaucgccgacugcccguacgaguacuacgaguacaccaucaaggagaccggggagaucaagcggcagggcaucaagugcaucgcuaagaguaacccguacuaccaggaguucagacuguggcaguuuaucaucaaccugcggcuguucgaccgcacggacgacaaggaggugacauccgaguaccugagcagcauggaggacuacacgaagcuguucacuuaccucaacgaccggaaggacaucaaccaggagacgcugcugaaggacuucuucaaacagaagaaggugaagauggggauggagaaggaguuccccauccguuggaacuacaucgaggacaaggagaagaaauaucccugcaacgaaacucggcacgagcuccuggcggcccuggacaaggcaggcaucgaucacuccuggcuggacgacaaagagcgguucuaccggcucuggcaccuccuauacagcgucgaguccaaggaggaagccgagggcgcgcuccguaaacucaaggacaacgacgacuucgugaacgccuuucugaaggugaagcccuucaagaaagacuacggggccuauucugaaaaagccgucaagaaacuccuggccauuaugcggaugggcgggcucuggaacgagaccgacaucugugagcaaacccgcaaccggauccaauccauaaucaagggcgagauagacgaaaagauaaaggaacggauggggcgcacguucugccagcugagcgacuuccagggccucccggagugguuagcgugcuacguggucuacggacggcauuccgaagccaccgacauacagcgcuggacuaagcccgagaaccucauggcguacaucaacggguucaagcagcacagccugcggaacccaaucgucgagcagugcaucuuggagacccuccgcaccgugcacgacaucuggaaggaagccggccauauugacgaaauccacgucgagcugggucggucuaugaaguccaccgcggaccaacgcgcccgaaugagcaagagcauccugcagaacgagaacaccaaccuccgcauaaagucacuguugauggagcucaagaacgcgaaggaaaucgagaacgugcggcccuacagcccgaugcagcaggagauccugcgcaucuacgaggagggcgcgcuacaggagcucacgaaggaggacgcccaauaccccgagauuuccaagaucucucagauggcgcaacccuccgcgaaggagcuucuaaaguaccggcucuggcuggagcagaaguacugcagucccuacaccggcaagccgauuagucugagcaagcuguuuacgagcgccuaccagaucgagcacauuaucccccagucacgcuacuucgacgauagcuucaccaauaaggucaucugcgagacggaggucaaccaacugaaauccaacaugcugggguacgaguucaucaagaagcacagcggugagaucgugcacuguaccacgaucggggacgugaagaucuuagacgcuaaagaguacuauaacuucgucaccgaacacuacgccaacaaccgacguaagaaggagaaacuucuucucgaggacaucccgcaggaguuccugaaccggcagaugaaugacucccgcuacaucagcaagaaagugauggcgauccugagcaacaucguucgggaggaggacgagcaagagaccaacagcaaguucguaguguccuguagcggcgggaucaccgacagacugaagcaggacuggggccugaacgauguguggaacuccauagucuacccccgguucgagcgccugaacaagcucacgcagacagaggccuucggccggugggagaacaaagaggggaagcaggucuuccagaccagccugccgcuggagcuccagcgcggguucuccaagaagagaaucgaccaccggcaccacgccauggacgcccuggugaucgcaugcgccagccgcaacaucaucaacuaccuaaacaaugaauccgccaagagccaggagcagcgugaggaccuccggaagaagcugugcgauaagaaccggaucauacgcaagccuugggagaccuuuacgcaggacgcccggaccgcccuggaggacgucguggugaguuuuaagaauuacgucagagugaucaacaaggcaacaaacuauuacgagaaguacgacgagagcggaaagaagggcauggccgagcagaaagggcaggacaugugggccauccgcaagccuaugcacaaggagaccguauuuggacaggucaaccucaggaggaaagugacugugaagcugaaagacgcccuggaaaacauuccggccaucugcgacaaggcgcuccgcgacuacguaaacgaccugaucgccaagaaguucaacaccaagcaaaugcuggcacauuucaagagcaucaacuacagacucaacaugaagagugucaacaaggugggcauauggguauucagcgacgagaaggagccuaugguggcgacgcgcaaggcaaucgacaucuccuucgacgcgaagcggauugauacgaucacggacaccgguauccagcagauccugugcaaguaccucaaguccaaggggaaugaccccaacguggcauucacucccgaggggaucgccgagaugaacaaacacaucaucgauuacaauaacggcaagcaacaccagccgauccugaaggugcgcguguccgagccgaagggggccaaauaccaggugggcgagacgggcaacaagacgaagaaguucgucgaagcccagaaggguaccaaccuguacuucgcgaucuacgaggacaaggacggcaaucgaagcuacaauacuaucccgcugaaugaaguggccgagcgccucaaacaagggcugucgcccgugccagagaagaacgaaaagggcaucagccugaaguuuuaccucuccccuaaugaccuggucuacgugcccaccgaggaggaaaagcugucgaacgagugcaaacucagcaaagagcguaucuacaagaugguuagcuccacgagcaaugaaugccauuucauucccuacaccaccgccaaaccgaucuacgauaaguucgaguacgaggccaagaacaagaugggacgcgcgcugacgggcgagaugaucaaggcagucugcuggaaacuugaaguggaccgccuuggcaacaucuuaaagaucaucaaguga

SEQ ID NO: 8037 - RNA, 4452 nt, Artificial Sequence
  Cas9 variant
augaagaccauccugggccucgaccucgggaccaacagcauuggcugggccaagaucuccauagacgacaacgggaauuaccugcgcgacauccagaugggcucucggaucauccccaugucacaggacgugcucgggaacuuugacagcggcgucacggagucacagaccgccgugcgcacuggcuucagaggccugcgccguauccgcgagcggagccuucuccgccgggagcgccugcaccgggugcugcaugucaugggcuuccucccgccccacuacgacuccgcgaucggguggaacaaggaggagcccaccacuuacggcaaguucuuaaaccacggggagcccaagcuggccugggagcgccagggagacggcagcaugcgguuccucuucauggacuccuuccacaagaugauggaggacuucgccccgcaccaacccgcccugguggccgacgggcgcaaaaucccccuggacuggacccucuacuaccugcggaagaaggcccugacacagcccaucaagaaggaggagcucgccuggauccugcugaacuuuaaucagaaacgcgguuacuaccagcuccgcggggaggaggaggaggagaacccgaccaagcgagaggaguaccaugagcugaagguaguaagcguggaggccgcugaggagggcaagggcgggaacacgugguacaacgugaagcuggagaauggcuggaucuaccgccgcuccagcaagaucccccucgaugacugggucgggaagacccggcccuucaucgugaccaccgaguacgaggcggacggcaucacgcugaagaagaacaaggagggggaggugaaaagguccuuccgcgccccgggcgaggacgacugggggcugcggaagaagcgcaccgagagccagcucgaggccuccgggaagaccgucggcgccuuuaucuacgaccaccuccuggccgagccggcggacaagauccgggggaauuucauccgcaccaucgagcggaaguacuacaagcaggagcuggcugacauuuugcgcgagcagagcaaguaccacgaggaguugcaguccaagaagauccucgccgacugcgccgaggagcuguaucggagcaaccagccccaccgcgacucccugcucaagaaggauaugguguacuuacugcucacggacaucaucuucuaccagcggccccucaagagcaagaagucccugaucgccgacugucccuacgaguacuaugaguacguggacaaggagaccggcgagaucaagcgccaggggaucaagugcgucgccaagagcaacccguacuaccaggaguuccggcuguggcaguucguacuuaacuuacgccucuacgaccggaccgaggacaaggaagugaccgcagaguaccugcccagcaaggaggacuacgccagacuguucgucuaccucaacgaccggaaggagaucaaccaggagacgcugcugaaagacuucuucaagcugaagaaggucaagcagcgcuccgagaaagaguuccccgugcgguggaacuacaucgaggacaaggagaagaaguaccccugcaacgagacccgccacgagcuccugauggcccuggaccgggccggcaucgagagaagcugguuagacgacaccgcgcgccagugccggcuguggcaccuccuguacuccauugaggucaaggacgaggccgagcgcgcccucaggaagcugaaggaugaugaugaguucgugagcgcauuccucaaggugaagccuuucaaaaaggacuacggcgccuacucagagaaggcggucaagaagcuacuggccgugaugcgcauggggagccacuggugcgaggacgacaucuguaaggagaccaaggagaggaucgaacacauccuccagggcgacgucgaggagaagaucaaggagcgcaugaaccacaccgcuuacucccugggggagcugagcgauuuccaggcccuccccgaguggcuugcgugcuacguaguguacggccggcacuccgaggccacggacaucaaacacuggaagacacccgagagccugauggccuacaucaacggguucaaacagcacucccuccgcaaccccaucgucgagcagugcauauuggagacccugcggacggugcacgacaucuggaaggaggccggccacaucgacgaaauacacguggagcucggccgcagcaugaaguccaccagcgaccaacgggcacgcaugaccgagaacauccugcggaacgagaacaccaaucugaggaucaaguccuuacugauggaacugaagaacgacgcggacaucaaagacguccggccguacagccccaugcagcaggagauucuccgcaucuacgaggagggcgcucugcaggaguuaacgaaagaggacaacgacuacgaggagaucuucaagauuuccaagaugccucagcccagcgccaaggagcucuugaaguacaagcuguggcucgagcagaaguaccggagcccguacaccggcaagcccaucucccugagcaagcuguucaccuccgccuaccagaucgagcacaucaucccucagagccgcuauuucgacgacucauucaacaacaaggugaucugcgagucagaggugaacgcccucaaggggaacaugcugggcuaugaguucauaaagaaccacggcggggagaucguccacugcacccugcucggcgacgugaaggugcagaacgagucagaguacaaggcguucgucacggagcacuacgccaauaacaaauacaagaaggagaagcugcuuauggaggacaucccucaggacuuccucaaccggcaccugaacgacagccgcuacaucuccaaggugguuaagacccugcucagcaacaucguccggaccgaggaugagauggagaccaccuccaaguucguggugaguugcaccgggggcaucacggaccgccugaagaaggacugggggcugaacgacgucuggaacuccaucguguacagccgcuucgagcggcucaaugaacugaccaaguccgacgcguucggccgcugggagaacaaggagggcaagaggguguuccagaccagcgucccccuggagcuccagcgcggguucaacaagaagcgaaucgaccaccgccaccacgccauggacgcccuggucaucgcgugcgcuucccggaacaucaucaacuaccugaacaacgaaagcgccaacagccccaagaagcgcgaagaccuccggcagcagcugugcgacaagaaccgcaucauccggaagcccugggaguccuucacgcaggacgcccgcgccgcccuugaggacguggucgugagcuucaaaaacuacgugcgggucaucaacaaggccaccaauuacuacgagcgcuacgacgcugacgguaagaagaccaucacaaagcagaagucccgggagaugugggccguucgcaagccgaugcacaaggagacgguguucggucacgucaaucuccggcgcaaggcgaucgugaagcugaaggacgcgcuggagaacaucccuagcaucugcaacaaggagcuccgggacuacaucaacggccugguugagcgcaacuucaacaccaagcagcugcaugcccacuuccgcuccaccgacuaccgguggaacaagcagaaugucgacaagguggaaguguggcgcuucagcgacgagaaggagccccucgucgccacccggaagcccuuggacacguccuucgacgccaagcgcauugacaccaucaccgacaccgguauccagaagauucugcucaacuaccuggaggccaagggaggcgacccgcugauugccuucacgcccgaggggaucgccgagaugaaccagaacaucgcccucuauaacgacggcaagaugcaccagcccauccugaaggugcggaucagcgagcccaagggggccaaauaccagaucggccagacgggcaacaaggcggacaaguucguggaggcacagaagggcaccaaccuguacuuugccaucuacgaggacgaggaccgcaaccggaccuauaacacgaucccgcucaaugaggucgccgagcgccugaagcagggcuuaccgcccgugcccgaaaagaacgagaaggaggugccccucaaguucuaccuguccccuaacgaccuggucuaugugcccaccgaggaggagauccucaugaaggagugcaagcugaacaagaaccggaucuacaagauggugagcuccaccgggaaucaaugcuucuucauacccuuccgcgucgcggugagcaucgugaacaaaauggaguacuccccgcugaacaagauggagaaggccaucagcuccgagaugaucaaggccgucugcuggaagcucgagguggaccggcugggcaauaucauccgcguggucaaguga

SEQ ID NO: 8038 - RNA, 4452 nt, Artificial Sequence
  Cas9 variant
augaagaccauccuggggcucgaccuuggaacuaacagcaucggcugggcuaaggugucgcuggaugacaacgguaacuaucuccacgacaucaagcuggguugccgaaucauccccaugagccaggacguccuggacaacuucgggaagggggugacugugucccagaccagcguccggacaggauuccgcgggguacggcggauccgggagcgcucacuucagcggagagaacggcugcacagaguccugcaccggcucggcuuccugccgcagcacuacgacgccgcuauagggugggacucugacugcgcuaaaacauacggcaaauuucuggacaacggagagccaaagcucgcaugggagcgccaggaggacggcuccaugcgguuccuguucaugaauagcuucuacgagaugauagccgacuuuacgucccaucaaccugcgcuggucgcggacggcaagaagaucccccucgauuggacccuguauuaccuucgcaagaaggcccucacccaggccauccguaaggaggagcuagcauggauccuguugagcuucaaccagaagcgcggguacuaccagcugcggggcgaggaagaggacgagaacccgaccaaacgcgaggaguuuugcgagcugaaaguugucgcgguugaggccgccgagaaggggaagggcgacgacauaugguacaacgugcaccucgagaacggcuguaucuaccgacgcuccagcaaaauuucccuggacgacuggguaggaaagaccaagcaguucaucaucaccaccgaguacgagaaggacggcgugacccccaagaaagauaaagacgggaaggagaagcguucuuaccgggcacccaaagaagacgacuggggccuucgcaaaaagcgaacggagaccgaccuagaagcguccgggaagacuguuggcgcuuucaucuacgagcaccuccuggccgagccuuucgacaagauccgcggcaacuucauccacacgaucgagagaaaguacuaccgcgccgagcuggaggccauccugacggagcagcgaaaguaccacgaggagcugcgcagcgagcagaugcucgccgugugcgcugaggagcuguaucgguccaaccuuccucaccagcagagccuccugaagaaggacauggucuaccugcuccugagugaccuaauauucuaccaacgcccccucaagagcaagaagagucugaucgccgacugccccuacgaguacuaccgcuacguggacaaggagaccggggagaucaagaagcagggcauaaagugcaucgccaaaagcaaucccuacuaucaggaguuccgcuuauggcaguucgugcucaauuuacggcuguucgauagaaugaccgacaaagaggucaccgccgacuacuugccgacgaaagaggacuacgugcggcuguuugacuaccugaacaacaggaaagagauuaaccaggagacccugcucaaggacuucuuccggcuuaagaaggugaaguuggggcgcgagaaggaguuugaaauccgguggaacuacauugaggacaaggaaaagaaauaccccugcaacgagacccgcuacgaacuccucgucgcccuggaccgcgcagggaucgaccgcagcuggaucgaugaggacgggcgccaguaccggcucuggcaccuccucuacuccauagaagugaaagccgaggccgagagcgcccugcggaagcugaacuccgaugaugcauucgugagcuccuuccugaagguuaagcccuucaagaaggacuacggugcguacagcgagaaggccgugaaaaagcuccuggccgucaugagaaugggcucuauguggagcgaggccaacauaugcgaggagacacagaaccgcaucagauccaucauccgcggcgacauagaggagaaaaucaaggaaagaaugggccacacggcgcgcagcuucaaccagaucgacgauuuccaagcucugcccgaguggcucgcauguuacgugguguacggucggcacucagagguaaccgacauccagcauugggagaccccggaacaacugcagucguacaucaacggauucaaacaacacucccuccgaaaccccaucguggagcagugcauacucgagacccugcggacgguacaugacaucuggaaggaagccgggcacaucgacgagauccaugucgagcugggccgugacaugaaacggacugcugaccagcgcgcgcggaugacgaagaauauccucaagaacgagaacaccaaccugcgcaucaaaagccuccucauggagcugaaaaaggauacugacaucaaggaagugcggcccuauuccccaaugcagcaggagauccuccgcaucuacgaagaaggggcguuacugcagcugaagcgggaugacgaggccuucgcugacaucaguaagaucucccaaauggcccagccgaccgcgaccgagcuccguagguacaaacuguggcuggaccaaaaguaccgcagccccuacacggggaaguucaucagccucuccaagcuguuuacgagcgccuaucagauugagcaugugaucccccagucccgcuauuucgaugauagcuucuccaacaaagucaucugugaggccgaggucaaccgacucaaaagcaacaugcugggcuacgaguucauaaaggcccacgggggagaaaucgugcauugcaccaugcugggcgaugucaagauacucuccgagagcgaguacaaggccuuugucaacgagcacuaugugaaccaccgcgcgaagaaagagaaauugcuuauggaggacaucccccaggaguuccugaaucgucagaugaacgacagucgcuauaucagcaagguugugaaggcucucuuauccaacaucgugcggaccgaggaugagauggacgucaccagcaaguucguggucccgugcuccgggggaaucaccgaccggcugaagaaggacuggggauuaaacgacgucuggaacagcaucguguacccacgguuugagcgccugaacaggaugacgggaacugaggccuuugggcacugggagaacaaggagggcaaacggguguuccagaccucaguacccauugagcugcagcucggcuucagcaagaagcgcaucgaccauaggcaccacgccauggacgcacugguaauagccugugccucccggaacaucaucaacuaccugaacaacgaaagcgccaauucacagaagaagcgagaggaucucagacgucugcugugcgacaagaaccguaucauucgcaaaccuugggaguccuucacccaggacgcccgaguggcgcuucaggauauagucgugaguuucaagaacuacgugcgaaucauuaacaaagcaacgaauuacuacgagcgcuacgacgagcaaggaaagaaaaccaccgccgaacagaaguccagcgagaugugggccauccggaagccaaugcacaaggagaccgucuucggccacgugaaccugaagcgcaagacaacaguuaagcugaagaacgccaucgagaacauccccaacaucugcaacaaggagcucaaggcguacaucaacgagcugguggagaaacauuucaacaccaagcaaauguuagcgcauuucaaguccauuaacuaccgguggaaucgccagaacguagagaaaguagaggucuggcaauacagcgacgaaaaggaacgaauggcggccacccgcaagccacucgacacguccuuugacaagaagcggaucgagaccaucaccgacaccgggauacagaagaucuugcugaacuaccucgaggagaaaggcggagacccgaauaucgccuucacgcccgaaggcauugcagagaugaacaagaacaucagccucuucaaugaugguaagcugcaccagcccauccuaaagguccgggucgcuaagaccaugggagcuaaguaccaagucggccagaccgggaauaaggccgcgaaguacguaggcgcucaggaggggaccaaccuguacuuugccaucuacgagaacgaggagggcgaacgguccuacaaugccgugccccuaaacgaggucgcggagcgccuuaaacaggguaugagcccgguacccgagaagaacgagaaggacgucccccugaaguucuacuugucgccaaacgaccucguauacguaccgacggaggaggacaagcugagcaaugagugcaagcuggauaacgagcggaucuauaagauggucagcgcaacugggaagaaaugccacuuccucccauacuccgucgccaacauuaucuauaacaagguggaguucgagaguaugaacaagaugggcaaggcccugagcggggagaugaucaaagccgugugcuggaagcuggaggucgaccgacuuggcacuauacugcgggugauuaaguga

SEQ ID NO: 8039 - RNA, 4452 nt, Artificial Sequence
  Cas9 variant
augaagaccgagcuggaccucaacaaggacagacuguacaagcacgugcugggccucgaccugggugucaccagcaucggcuucgcccacguggucgaguccgagaaccggaacgaguccgaaaucaagcagaucgggguccgcgugauucagcuggacaacuucgacaaaguggacaaguccggaaagaccagcgaguccaagaacccggcugucgacuucgcggccgggaaggggcucaccccgaacggcagccggaccaagaagcgcggggcccggcgcaaccuugaccgcuaucaggacagaagagacaaccuccucgaagugcugacgaagaguggcuucaucaacuccgagacgaagcguaccgaggacgguaagcacaccacccaccagacaugggagauccgggccaaggccguguccgagaaggucgagaaggaggaauuugcgcgcauccuguuagcaauuaacaagaagcggggcuacaagagcucccgcaaggccaagaacgaggacgaggggcaggccguggacggcauggcgguggcuaaacggcuguacgaggagaaccuaacccccggacaguacgccuacgagguccugucagggggcaagaaguccauucccgacuucuacagaagcgaccugcaggccgaguucgacaagaucuggaacuuccagaagcaguucuaccccaacauccuuaccgacgaguucuacgaggagcucaaggggaaggggcagcgggccacguccgcggcuuucuggaagauccaccaguucaacacggccgacaucaaggaccuggaggacgagcuaaagaacgaacgcaccaucaagcucagcaagcgggaucagaagaagcugcaggccuacaaguggcgcuccgaagcggugguaaagcaguugggcaaggaagaggucgcguacguucucaccgagauaaacaauaaccugaauaacagcuccggguaccuuggcgccauaagcgaccggucaaaggagcucuacuucaacaagcagaccgugggacaguuccuguacaagcagcugaaggagaacccgcauacgcgccucaaaaaccaggucuucuaccgccaggacuaccuggacgaguucgagaccauaugggagaugcaggcccaguuccaccccgagcugacccaggaguugaaggaggagauccgagauaucaucaucuucuaccagcgcaagcugaagucacagaagggucugaucucguuuugcgagcucgaguccaaagagguugugaucaacgacacgaagaagaucaucgggcugcgggucgccccuaagagcagcccccuguuccaggaguucaaaaucuggcaaaaucucaauaacgugcugguucgcaagaagggaagccggaagaggauggucaaggcccagaaccagcacucccuguuugaggagccgaaggagaucuucagccucgaccuggcaucuaaggagaaacuuuucgaggagcucaaccugaagggcaaucugucggccaagaacugccucgacauccuggggcugaacuccaacgagugggagcugaacuacacgcagcuagaaggcaaccggaccaacaagucacuguacgaggccuuccugaagauccuagacaucgagggguacgacgugaaggaccugcugaaggucaagucauccaaggaugaaguggaauuggacgaccugaaggugcccgccuccgagaucaagaacaugguccgcgagaucuucagcacgaauaagaucgacaccgagaucuuggacuucgacgccgagaucgacggcaaggcuuucgagaagcaguccagcuaccagcucuggcacuuacuuuacagcuacgagggugacgauagccagagcgggaacgagaaguuauacgagcugcuggccaagaaguucggcuucaaacgggagcacgcccagaucuuggccaacgucucccugguggacgacuaugggaaccugagcuccaaggcgaugcgcaagaucuacccccacauccgggagaacaacuauagcacugccugcgaacucgucggcuacaggcacuccaagcacagccugaccaaggaugagcugaaggaucgggugcucgaggaccgccuggaacuguuaaagaaaaacucucugcggcagcccguggucgagaagauccugaaccagaugaucaacgccgugaacgcccucaucgagaagaacagcgagcgcgacgagaacggaaacauaaccaaguacuucaaguucgacgaaauccggaucgagcuggcccgcgaacugaagaagaacgcggcggagcgcgccgagaugacgacgaacaucaacgccgccaagcucgugcacgagaagaucuucaagauccuucagaacgaauuuggcaucaagaacccgacacgaaaugacauaauccgcuaccgccuguacgaggagcugaaggggaacggcuacaaggacuuauacuccaacaccuacaucccccgcgagauccuguucagcaaccagaucgacauagaucacauccuuccccaauccaggcuguucgacgacagcuucuccaauaagguagugguguuccgcaaagacaaccugaagaagggcaaccaaacggcaaucgacuacaucgggagcgaggucggagaggaggggcugaagaacuucaucgagcggguggagucucuguacgagcugggcaagaagaacaaggaggaaggcaucagcaaggccaaguaccagaagcuacugaaguccgccagcgagauaggggacggcuucaucgagcgugaccugcgggagagccaguauaucgccaagaaggccaaggaguuacuauucaaggugacucgcuccguggucagcaccuccgggagcauuacagaucggcugcgcgaggacuggggacucaucaacguaaugaaagagcugaacuugcccaaguacaagagccucggacucacagagauccaggagcggcgcaacggucaccaggucgaagugaucaaggacuggacgaagcggaacgaccaccgccaccacgccauggaugcccuggcaguggccuucacuaagcacaaccacauccaguacuuaaauuaccugaacgcgcggaagaacgagagccacaagcugcacggcaacaucauagccaucgaaacccuugaaacagaggucaagaucgacgaccucgggaauaagaagcgcguguucaaggagccgaucccaaacuuccgccagguggcaaaggagcaucuggagaacguccucauuucccacaaggccaagaacaaggucgucaccaaaaacaagaacaagaucagcgggaaggagaagcugcagaucacgcugacgccccgggggcaguuacacaaggagacuguuuacggcaaguaccgguucuaccaguccaaggacgagaaggucagcgccaaguucgaccuggaaaccaucgagaagguggcgaaccccuccuacaaggccgcccugcugcagcgccugaacgagaacgaaaacgaccccaagaaggccuucagcgggaagaaugcccugucaaagaaccccaucuacaucagcauggagaaugacaucaaagucccggacaccgugaagcucguguggcuagaggaggacuacuccauccggaaggacgucacaccugagaacuucaaggacgagaagucaaucgagaagauccuggacgaaggcgugaaacgcaucuugaagaaccgccugaaggaguucggcggggacgcgaaggaggccuuuuccgaucuggacaagaacccgaucuggcucaacgaggaaaaaggaaccagcaucaagcggguucgcaucuccggggucaagaacgccgagccacugcacuauaagaaggaccacuuuggcaacgacauucuggacgguaacggcaacaagauccccgccgacuuugugagcaccggcaacaaccaccacguggccaucuacaaggagcccgaguucgacaagaaggggcagccgguccucgacgagcuuggcaaccaaaaguacaaccugcaagagaagguggugucguucuucgaggcugucgagcgcgugaaccaggggcuccccaucaucgacaagacguacaaccagcaccugggcuggcaguucuucuucaccaugaagcaaaacgagauguucguguuccccaacgagaagacccgcuucaacccgaucgagaucgaccugcucgaccccaacaacaagaagcugaucucucugaaccucuuccggguccagaagaucgccaacaagaacuacauguuccgccaccaccuggagacaaacgucgaugacaagaaggagaugaagaacaucgccuucauccauauccaaagcugcaaccugcuuaaggagaucaucaaggugcggcugaaccaccugggggauaucgucuccgugggcgaguacuga

SEQ ID NO: 8040 - RNA, 4452 nt, Artificial Sequence
  Cas9 variant
augaagaccauccuaggccucgaccuggggaccaauagcaucggcugggccaaggugucaguggacgaccacgguaacuaccugcacgacauaaaacucggcagccgcaucauacccaugucccaagacaucuuggggaacuuugacaagggcgugacggagagccagaccgcuauccggacuggcuucagguccgugcggaggauccgagagcgcagccugcugcggagggagcggcugcaccgaguacugcacgugaugggcuuucucccgccucacuacgacagugcgaucggcuggaaccgggaggaggcuagcaccuacgggaaguuccugaaccacggcgagcccaagcuggccugggagcgccucgaggauggguccaugcgguuccucuuuauggacucguuucacgagaugauggcgaacuucgcacgccaccaacccgcgcugguggccgacggucggaaaaucccgcucgacuggacgcuguacuaccugcgcaaaaaggcccucucccaagcugucggcaaggaggagcuggccuggauccugcucaacuucaaucaaaagcggggguauugccagcuccgaggcgaggaggaggaggagaccccaacgaagcgggaagaguacuacgagcugaagguggugucugucgaggccgccgaggaggguaagggcggcaacaccugguacagagugcagcucgagaacggauggaucuaccggcgcccguccaagauagcccuagacgacugggugggcaagacgaaacaguucauagucacuaccgaguacgagaaggacgggaccacacugaagaaggacaaggacggcgaggugaagcgcagcuuccgagccccgggggagaacgacuggggacuucgcaagaagcggaccgagucgcagcuggaggcgagcgguaagaccguuggggcauucaucuacgaccaccuccuggccgagccggccgacaagauccgcggcaacuucauucggacuaucgaaaggaaguacuacaagcaggagcuggaggccauccuacgggaacagacgaagcaccacgaggagcuccgcagcaaggagaugcuugccaagugcgcggaggaguuguaccagagcaaccagccccaucguaagucgcuccugaauaaggacaugacauaccugcuccugaccgaccugaucuucuaccagcgaccccucaagagcaagaagucccucaucgccgaaugcccuuacgaguacuacaaguacaaagacaaggaaaaagggaaaaagaagcggcagggcauaaagugcgucgccaagucgaacccguacuaccaagaguuccgccuauggcaguucaucgugaaucuccgucuguucgaccgcaccgacgacaaggaggugacggcugaguaccugcggucucgcgaggacuacgcgcggcuguucgcuuaccugaacgaucgcaaggagaucaaucaggagaccuugcugaaggauuucuucggucuaaagaaggucaagaucggcgcagagaaagaguucgccauccgguggaacuacaucgaggacaaggagaagaaguaucccugcaacgagacccgccaugagcuacugcuagcccuggaccgagcgggcauggaccgguccuggcuggacgacagcgaacuccaguaccgccuguggcaccuccuuuacuccguggaggcccgggacgaagccgagggggcccugcgcaagcugcgggacgacgacgaguucgugggagcauuucucaaggucaagcccuuuaagaaggacuacggggcuuacagcgagaaggccguaaagaaacugcuggcagugaugcgcaugggauccugguggcacgaggaggacaucugcaagcagacccgggaucgcaucgagcggaucguccagggcgacaucgaggagaaaauccgugagcgaaugggccacgcagcguacaguuuuucccgcuuagccgacuuccagggccuacccgaguggcuggccugcuauguggucuacgggcggcacagugaagccacgcacauccuccgcugggacuccccggacaaacuguuaagcuacauaaagggcuuccggcagcacagccuccgcaaccccaucguggagcagugcauucuggaaaccuuacggacgguacacgauaucuggaaggaggcugggcacaucgacgagauccacgucgagcucggacgcagcaugaaguccaccgcggagcagcgggcccacaugacgaagaacauccugcggaacgagaacaccaaccugcggaucaagugccuucugauggagcuaaagaacgaugccgacgugaaagacguucgcccauacagcccgaugcagcaggagauccuccgcaucuacgaagagggcgcccugcaacagcugaccaaggacgacgcugaguacgcggagauuuccaaaaucagcaagauggcacagccgagugccaaggagcuccugcgauacaagcuguggcuagagcagaaguaccgcucgccuuacaccggcaagcccaucagccuguccaagcuguucacgagcgccuaccagaucgagcacgucauaccccagucccgguauuucgacgacagcuucaacaacaagguuauaugcgaauccgaagugaacacccucaagagcaacaugcugggcuaugaguucaucaagaaccauuguggggaaaucguccauugcaccaugcugggcgacgugaagguguucucugagagcgaguauaaggcauucgucacugaacacuauucuaacaauaaguacaagaaggaaaagcucuuacuggaggacaucccgcaggaguuccucaaucgccagaugaacgauagccgguacaucuccaaaguggugaaggggcuccuuagcaacgucgugcgcacggaagacgagcucgaggccaccuccaaguucguggucagcugcaccggcggcaucaccgaccggcugaagaaggacugggggcugaaugacgucuggaacuccaucguguacagccgcuucgagcggcucaacggcuuaaccaaguccgagcacuucgggcacugggagaacaaggaggguaagcgggucuuccagacgagcgugccaauggagcugcagaggggguucaauaagaaacgcauugaccaccggcaccacgccauggacgcucucgugaucgcaugcgcgagcagaaacaucaucaacuaccugaacaacgaguucgccaaguccccuaaacaacgggaggaccugcgccagcuccugugugacaagaacaggaucauccgcaagcccugggagaccuucacgcaggacgcccgggccgcccuggaggacgugguggugagcuucaagaacuacguccgcgugaucaacaagaccacgaacuacuacgagcgcuacgacgcggacggcaagaagaccaugguaccgcagaaggggaacgaaaugugggccguccgcaaacccaugcacgaggggaccauguacggccgcgugaaucuccggcgcaaggccguggucaagcugaaggaggcccuggagaauauauccagcaucugcaacaaggaacuccgugacuauaucaaugugcugguggagaaacaauucaacaccaagcaacuccucgcccacuuuaaguccauggacuaccgcuggaacaaacagcauaucgauaagguagagguguggagguucagcgacgagaaggugcaaaugguugcggcccgcaagccucuggacacguccuucgacaaggaaugcaucgccagcaucaccgacaccggaauccagaagauccugcucaacuaccuggaguccaagggcggcgauccggccaucgcguuuaccagcgagggcaucgccgagaugaaccaaaacaucgccguauacaacgacggcaagaagcaccagccuguuaucaagguccggaaguccacgaaguuagguaagaaguuugccgugggccagauuggguguaagagcaaacaauuugugguagccgaagcgggcaccaaccuauacuucgcaauuuaugaagacgaggaggggaagcgaagcuacgauaccaucccccugaacgaggugacugagcggcugaaacagggccucagcccagugccggagaagaaugagaaggaggucccgcuuaaauucuaccugucccccaacgaccuaguauacgugccgacggaggaugaaaugcagaugaaggagugcaaacugaauaaggagcgcaucuauaagauggucagcagcaccggcaaugagugccauuuccugccguacucuguagcauccgugaucuacaacaaaguggaguucgagagcaugaacaagauggggcgggcccucaccggugagaugaucaaagcagugugcuggaaacuagacgucgaccgcuuagggaacauucuccgggugaucaaguga

SEQ ID NO: 8041 - RNA, 4452 nt, Artificial Sequence
  Cas9 variant
augaagaccauccuaggccucgaccugggcaccaacucuaucgggugggccaagaucuccaucgaugauaacgggaacuaccugcgcgauauccagcucggcucgcggaucauccccaugucccaagacgugcuggggaacuucgacaacggcgugacggagagccagaccgccgugcgcaccggguuccgggggcugcgaagaauccgcgagcggucccuccugcgccgggagcgccugcaccgggugcuccacgucaugggcuuccugccgccccauuacgacagcgcgaucggcuggaacaaggaggaacccaccacguacggcaaguuccugaaccauggggagcccaagcucgccugggagcgccagggagacggcuccaugcgguuccuguucauggacagcuuccacaagaugauggaagacuucgcuccgcaccagcccgcacugguggccgacgggaggaagaucccccucgacuggacccuauacuaccugcggaaaaaggcgcuuacccagcccauaaagaaggaggaacuggccuggauccugcucaacuucaaccagaaacgcgguuacuaccagcugcgcggggaggaggaagaggagaacccgaccaagcgggaggaguaccacgagcugaagguggucggcguggaggccgccgaggaaggcaagggcgggaauacgugguauaacgugaaguuggagaacggguggaucuaccggcgcaguagcaagaucccccuggacgacugggucggcaagacccggcccuucaucgucaccaccgaguacgaggcggacgggauuacgcugaagaagaacaaggagggcgaggugaagcgcuccuuccgcgccccuggcgaggacgacugggggcucuggaagaagcggacagagagccagcuggaggccuccggcaagaccguaggagccuucaucuacgaccaccuccuggccgagccggcggacaagauccgcggcaacuucauccggaccauagagcgcaaguacuauaagcaggagcuggccgacauccugcgggagcagagcaaauaccacgaggagcuccaguccaagaagauucuggccgacugcgcagaggagcuguaccgcagcaaccagccccacagggacucccuccugaagaaggacaugguguaccugcuccugacagaccuuaucuucuaccagcgaccccucaagagcaagaagucccucaucgccgacugccccuacgaguacuacgaguacguggacaaggagaccggggagauaaagcggcaggggaucaaaugcaucgccaagagcaacccguacuaccaagaguuucgucuguggcaguucgugcucaaccugcggcuguacgaccgcaccgaggacaaggaggugaccgcggaguaccuccccagcaaggaggacuacgcccggcuguucguguaccugaacgaccgcaaagagaucaaccaggagacccugcucaaggacuucuucaaacuuaagaaggucaagcagcggagcgagaaggacuuccccguucgguggaacuacaucgaggacaaggaaaagaaguaccccugcaacgagacccggcacgagcugcucauggcccuggaccgcgccggcaucgagcggagcuggcuugacgacaccgcgcgccaguaccgccucuggcacuuacuguacuccaucgaggugaaggacgaggccgagcgcgcccugcgcaagcugaaggacgacgacgaguucgucagcgcuuuccugaaagugaagcccuucaagaaggacuacggggcauacucugagaaggcggugaagaagcuccucgccgucaugcggaugggcagccacuggugcgaggacgacauuugcaaggagaccaaggagcgcauugagcacauccugcagggcgacgugggcgaaaagaucaaggagcggaugaaccacacggcauacucccucggggagcugagcgacuuccaggcccugcccgaguggcucgcuugcuacgucguauacggccgccauuccgaggccacagacauuaagcacuggaaaacccccgagagccugauggccuacaucaacggcuucaagcagcauucccugcggaaucccaucguggagcagugcauccucgagacccugcgcacgguccacgacaucuggaaggaggccgggcacaucgacgagauccacguggagcuuggccggagcaugaaguccaccagcgaccagcgcgcccguaugaccgagaacauccuccgcaacgagaauaccaaccugcggaucaagucccugcucauggaacugaaaaacgacgcggacaucaaggacgugcgcccguauucccccaugcaacaagagauccuccggaucuacgaggagggggcucuccaagagcugacgaaggaggacaacgacuacgaggagaucuucaagaucuccaagaugccucagcccagcgccaaggagcugcucaaauacaagcuguggcuggagcagaaguaccgcuccccguacaccggcaaacccauuagccucagcaagcuguucaccuccgccuaccagaucgagcacaucaucccccagagccgguacuucgacgacuccuucaacaacaaggucauaugcgagagcgaggugaacgcccugaaaggcaacaugcucggguacgaguucaucaagaaccacggcggggagaucgugcacugcacccugcugggggacgucaaggugcagaaugaauccgaguacaaggccuucgugaccgagcacuacgccaauaacaaguacaagaaggagaagcuccugauggaggacaucccgcaggacuuccugaaccgccaccucaacgacagccgguacauauccaaggucgugaagacccuguugagcaacaucgugcgcaccgaggacgagauggaaaccaccuccaaguucgucgugagcugcacuggggguaucacggaccgucucaagaaggacuggggccugaacgacguguggaacuccaucguguacucucgcuuugagcgccugaaugagcucaccaaguccgacgccuucgggcguugggagaacaaggagggcaagcgcgucuuccagacgagcgugccccuggagcugcaaaggggguucaacaagaagcgcaucgaccaccgacaccacgccauggacgcgcucgucaucgcgugcgccucccgcaacaucaucaacuaccugaacaacgagagcgccaacucccccaagaagcgcgaagaccugcgccagcagcucugcgacaagaaccggaucauccgcaagcccugggagagcuucacgcaggacgcccgggcggcccuggaggacguggugguuagcuucaagaauuacgugcgugugaucaacaaggcgaccaacuacuacgagcgguacgacgcagauggcaagaagaccauaacgaagcagaagucgcgcgagaugugggccgugcggaagccgaugcacaaggaaacgguguucgggcacgucaaccugcgacggaaagcgaucgucaagcucaaggacgcccuggagaacauccccagcauaugcaacaaggagcugcgcgacuacaucaacggccucguggagcggaacuucaacaccaagcagcugcacgcccacuuccgguccaccgacuaccgcuggaauaagcagaauguggacaaggucgagguguggcgguuuagcgacgagaaggagccucugguagccacacguaagccccucgacacgagcuucgacgccaagcggaucgacaccaucaccgacaccggaauacagaagauccugcugaacuaccuugaggcgaagggcggggacccgcugaucgccuucacgcccgaggggaucgccgagaugaaccagaacaucgcccuguacaacgacgggaagaugcaccagccgauccuuaaaguccgcaucagcgagcccaagggggccaaguaccagaucggccagaccggcaacaaggcggacaaguucguggaggcccagaaggggaccaaccuguacuucgccaucuacgaggacgaggaucggaaucgcaccuacaacaccaucccgcuaaacgaagucgccgaacggcucaagcagggccugccgcccgucccagagaagaacgagaaggaggugccccugaaguuuuaccucucccccaacgaccugguguacguccccaccgaggaggagauccugaugaaagagugcaagcucaacaagaaccgcaucuacaagauggucucuuccaccggcaaccagugcuucuucauccccuuccguguagcggucagcaucgugaacaagauggaguacucuccgcugaacaagauggagaaggccaucagcuccgaaaugaucaaggccgugugcuggaagcuggaggucgaccgccucggcaacaucauccggguggugaaguga

SEQ ID NO: 8042 - RNA, 4458 nt, Artificial Sequence
  Cas9 variant
augaagaacauccugggccucgaccuggggaccaacagcaucggcugggccaagaucuccaucgacgacaacgggaaguacaucaaggacagcaucaagcugggcucccgcaucauucccaugagccaggacguccucagcaacuucagcaagggggucacccugucccagacgagcgagcggaccuccuuccgcggcgcccggcgccugcgggagcgcacccuccugcggcgcgagcggcuccaucgcauccuccaucugcugggcuuccucccgaagcacuacgagaaggcgaucgggugggaccggaacgacaacaaaaccuacggcaaguucaucaaccacgccgagcccaagcuggccuggugcaaggacaacaacgggaagaugcgcuuccuguucauggacagcuuccacgacaugcucucagaguucagcgagaagcaccccgagcugcuggcuaacggcaagaagaucccccucgacuggacgaucuacuaccugcggaagaaggcccuguacaaggcgauuaccaaagaggagcucgccuggauccugcugaacuucaaccagaagcgcggguacuaccagcuccggggcgaggaggaccgcgacuccgaggccaacaagaaggaguaccuggagcugaaggugaucggcguggaggccacuggggagaagaagggcaacgacaucugguacaacauccaccucgagaacggguggaucuaccggcgcagcuccaagaacccgcugaacgacuggcugggcaaggucaagagcuucauagugaccacggaccuugacgcggacggaaaccccaagaaggacaaggacgggaacaucaagcgauccuuccgcgcccccucagagggcgacuggacccuuaucaagaagcggaccgagucccugcucgagaacagcgggcagaccgugggccaguucaucuacaaccacauccuggaggagcccagcgccaagauccgcgggaacuucauccgcacgaucgagcggaaguacuacaaggacgagcugaaggccauccucgagaagcagaaggaguuucaccacgaacuguccagcgagucccugcucaccgaaugcgccaaggagcuguauaagcgcaacauugcacaccaggagguccugcuaaagaagggcaugauccaccuccugcugaacgacauccuguucuaucagcggccgcuuaagaucaagaagucccuaaucgacaacugccccuacgagaacuacaaguacguggacaagaaguccggcgacaucaaggucaagagcaucaagugcaucgccaagagcaaccccuucuuccaggaguuccgccuguggcaguucgugagcaaccugcggcuguaccgcaaguccgacgacaaggacgugaccagcgagcaccucgugaccacggacgacuacgccaaucuguucaccuaccugaacaaccggaaggacauaaagcaguccguccuccugaaagaguacuucaagaucaagaaagugaagaccaucaacggggccgaguaccccgugcgcuggaacuacaucgacgacgacaacaagaccuacccuugcaacgagacgcgguacgacauccugcacgcccucagcaagaccgaacugaaguccgaguggcugacccccgagcgcaccuaccggcucuggcaccuccuguacagcaucgaguccaaggaggagacgaagaaggcgcugaacaagcugaaccugagcgacgacuucaccgaggccuuccucaccaucaagcccuuuaagaaggaguacggcuccuacagcgagaaggccaucaagaagcugcugucccucaugcgaauggguuaccuguggagcgaggacgaggccaucaagcaggucggcgccgagaucgagaagaccaucgagggggagcugcccgacuacgugcuccagcggcuggagaagucccagcacaacuacaacaagaucagcgacuucagcggccugccgcucuggcuggcguccuacaucaucuaugggcgccacagcgaagccaaggagaucauccacugggacaaccccgaguccaugauggccuacaucaaagacuuccggcagcacagcaugcgcaaccccaucguagagcaguguguccuggagacccuccggaccgugcacgacaucuggaaggaaaucgggcacaucgacgagauccacaucgagcugggccgcgagaugaaauccaccagcgagcagcggaaggccaucacccagaacgugcugcacaaccagaacacgaacauccgcaucaagcuccugcugcaggagcucaagaacgacaacaacaucaccggcguccgccccuacuccccgaugcagcaggagauccugcggaucuaugaggagggcgcccugcaggggcuaaccaaggaggacaaggacuacaacgacauccugaagaucagccagacagcgcagcccacguccaacgagcugacccgcuacaaacucuggcuggagcagaaguaccggagcccuuacaccggcaaggccaucucccugagcaagcuguucacguccgccuaccagaucgagcacgugaucccccagagccgauacuucgacgacucccugagcaacaaggugaucugcgagagcgaggucaacacccugaagaaggccaugcucggcauggaguucaucaagacgugcggaggccagaaggugcacugcacccugcugggggacgucgagaucuacaacgaggaggacuacaaggcguucgugaacgagcacuacuccaacaaccggaccaagcgcaacaagcuccugauggaggacauaccgcaggaguucaucaaccggcagcugaacgacagccgcuacaucuccaagauggugaagcagcuccugagcgccaucguccggggccaggaggagguggaggccaccuccaaguucgugauccccugcacgggcgggaucacagaccgccugaagaaagacuggggccucaacgacaucuggaacaaccuggugagcccucgguuccagcgcaugaacgcccugaccggguccgaauacuucggccacugggagaacaaggaggggaagcggguguuccagaccacgaugcccauccagcuccagcagggcuucagcaagaagcgcaucgaccaccggcaccacgccauggacgcgcuggugaucgccugcgccucccgcaacaucaucagcuaccugaacaacgagaccgcccaggacaccgagcggcgccgggaucuccgccagaagcugugcgacaagggcggguccguccggaagccgugggacagcuucacccaggacacucaguacgcccugaaggacaucaucguuaccuucaaaaacuacgugcgcaucaucaacaaggcgaccaacuacuacgagcacuacaagaccgacggcaaaaaggguaugaucucccagaagggcgacgagcucugggccaucagaaagcccaugcacaaggagacggucuucgggaaggugaacuuacggcgccccaagcgggugagccuguccaaggccaucgacagcgucgacgugaucugcaaccgcaagcucaagaaguacaucaaggcccggcugaacgaaggccugcagaagaagcagauccucaacaucuucaaggaggugaacaacgucugggagggcaucgacgugaacaagaucgacaucugggagauguccaacgacaaggagccgaugguggccacccgcaagcagcuggacaccagcuucgacgagaaaaagauccgguccaucagcgacacagggauccagaagauccugcucaacuaccugaucacgaagaacaacaaccccgagcuggcguucacccccgagggcauccaggagaugaacagcaacaucagcgaguacaacgaccacaagaagcaccagcccaucuacaagguccgcgugaccgagccgcucggggccaaguaccccaucggcaccauggggaacaaccccaagaaguucguggaggcccaggccggcacgaaccuguacuucgcgaucuacgaggacaaggagggcaaccggaacuacgacaccaucccccugaacaucgccgccgagcgccucaaccagcagcugagcccgguccccgagaccaacgagaacaacacgccccugaaguuuuaccucucccccaacgaccugguguacgugcccuccgaggaggagcggcacuccgggaacaacauccagcuggacaagaaccgcaucuacaagaugguuuccuccaccucuaagcaguguuucuucauccaccaccggguggccauuucccucguggacaagaaggaguucuccgcccagaacaagauggagcgcuccaucgacaacgagcaggucaugaucaagagcgugugcuggaagcugaucaccgaccggcugggcaacaucauuaaggugaucaaguga

SEQ ID NO: 8043 - RNA, 4458 nt, Artificial Sequence
  Cas9 variant
augaagaacauccugggccucgaccuggggaccaacaguaucgguugggccaagaucuccaucgaugacaacgggaaguacauuaaggacagcaucaagcugggcucccgcaucauccccaugagccaggacguucucuccaacuuuagcaagggggucacccugucacagacgagcgagcggaccucauuccggggcgcccggcgccugcgggagcgcacuuuacugcggcgcgagcggcugcaccgcauccuccaccuccugggcuuccucccgaagcacuacgagaaggcgaucgggugggaccggaacgauaacaagaccuacggcaaguucaucaaccacgccgagcccaagcuggcguggugcaaggauaacaacgggaagaugcgcuuccuguucauggacagcuuccacgauaugcucuccgaguucagcgaaaagcaccccgagcugcuggccaacggcaagaagaucccccucgacuggacgaucuauuaccugcggaagaaggcccuguacaaggcgaucacgaaagaggagcucgccuggauccugcugaacuucaaccagaagcgcggguacuaccagcuccggggcgaggaggaccgugacuccgaggccaacaagaaggaguaccuagagcugaaagugaucggcguggaagccaccggggagaaaaaggguaacgauaucugguacaacauucaccucgaaaacggguggaucuaccggcgcagcuccaaaaacccgcugaacgacuggcugggcaaggucaagagcuucaucgugacgacggaccucgaugcggauggcaaccccaagaaggacaaggacgggaacaucaagcggucauuccgcgcccccagcgagggcgacuggacccugaucaagaagcggaccgagucacuacucgaaaacagcgggcagaccgugggccaguucaucuacaaucacauccuggaggagcccagcgccaagauccgcgggaacuucauccgcacaaucgagcggaaguacuacaaagaugagcugaaggccauccuagagaagcagaaggaguuucaucacgagcuguccagcgaauccuugcucaccgagugcgccaaggaacuguacaagcgcaacaucgcgcaccaggagguacugcucaagaagggcaucauccaccuccugcugaacgacauccuguucuaccagcggccgcugaagaucaagaagucccugaucgacaacugccccuacgagaauuacaaguacguggacaagaaguccggcgacauaaaggucaagagcaucaagugcauagccaagagcaaccccuucuuccaggaguuccgccuguggcaauucguaucgaaccugcggcuguaccgcaagucggacgacaaggacgugaccagcgagcaccuagugaccacggacgacuacgccaaccuguucaccuaccugaacaaccggaaggacaucaagcaaaguguucuccugaaggaauacuucaagaucaaaaaggugaagaccaucaacggggccgaguacccggugcgcuggaacuacaucgacgacgacaacaagacguacccgugcaaugagacgcgcuacgacauccuccacgcccucagcaagacugagcugaaguccgaauggcugacccccgagcgcacauaccggcucuggcaccuucuguauagcaucgaguccaaggaggagacuaagaaggcguuaaacaagcugaaccugagcgacgauuucaccgaggccuuccucaccaucaagcccuucaagaaagaguacggcuccuacagcgagaaagccaucaagaaacuucugucccuaaugcgcaugggguaccuguggagcgaggacgaggccauuaaacaggugggcgccgaaaucgagaagaccaucgagggggagcugcccgacuacguucuccagcggcuggagaagucccaacacaacuacaacaagaucagcgacuucagcggcuuaccgcucugguuggcguccuauaucaucuacggccgccacagcgaggcaaaggagaucauccacugggacaaucccgaguccaugauggccuacaucaaggacuuccggcagcacagcaugcgcaaccccaucguggagcagugcguccuggagacgcuccggaccgugcacgacaucuggaaggaaaucgggcacaucgacgagauccacaucgagcugggccgcgagaugaaguccaccagcgagcagcggaaggcgaucacacagaacgugcugcacaaucagaacacgaacauccgcauuaagcuccugcugcaggagcucaagaacgacaacaacaucaccgggguccgccccuacuccccgaugcagcaggagauccugcggaucuacgaggagggagcccugcaggggcucaccaaggaggacaaggacuacaacgacauccugaagaucagccaaaccgcgcagcccacgucuaacgagcugacccgcuacaaacucuggcuggagcagaaguacagaucgccguacaccggcaaggccaucucccugagcaagcuauucaccuccgccuaccagaucgagcacgugaucccucagagccgcuacuucgacgacucccugagcaacaaggugaucugcgaaagcgaggucaacacccugaagaaggccaugcucggcauggaguucauaaagacgugcgggggccaaaaggugcacuguacccugcuaggggacgucgagaucuacaacgaggaggacuacaaggcguucgugaacgaacacuacuccaacaaccggaccaagcgcaacaagcuccugauggaggacaucccgcaggaguucaucaaccggcagcugaacgacagccgcuacauuuccaagauggugaagcagcuccugucagccauaguccggggccaggaggagguggaggccaccaguaaguucgugauccccugcacgggcgggaucacagaccgccugaagaaggacuggggccucaacgacaucuggaacaaccuggucucaccccgguuccagcgcaugaacgcccugaccggguccgaguacuucggccacugggagaacaaggaggggaagcggguguuccagaccacgaugcccauucagcuccagcagggcuucagcaagaagcgcauugaccaccggcaccacgccauggacgcgcuggugaucgcaugcgccucccgaaacaucaucagcuaccugaacaacgagaccgcccaggacaccgagaggcgccgggaccuccgccaaaagcugugcgacaagggcggguccguccggaagccgugggacagcuucacccaggacacgcaguacgcccugaaggacaucauugugaccuucaaaaacuacgugcgcaucaucaacaaggcgacgaacuacuacgagcacuacaagaccgacggcaagaaaggcaugaucucccagaagggcgaugaacucugggccauccgcaagcccaugcacaaggagacggucuucgggaaggugaaccugcggcgccccaagcggguaucgcuguccaaggccaucgacagcgucgacaucaucugcaaccgcaagcucaaaaaguacaucaaggcccggcugaacgagggcuuacagaagaagcagauccucaacaucuucaaggagcugaauaacgugugggaggguaucgacgugaacaagaucgacaucugggaaauguccaacgacaaggagccgauggucgccacucgcaagcagcuggacacgagcuucgacgagaagaagauccgguccaucagcgacaccggaauccagaagauccuccugaacuaccugaucacgaagaacaacaaccccgagcucgcguucacccccgagggcauccaggagaugaacagcaacaucuccgaguacaacgaccacaagaagcaccagcccaucuacaaggugcgcgugaccgagccacugggggccaaguaccccaucgggaccaugggcaacaacccgaagaaguucgucgaggcccaggccggcacgaaccuguacuucgcgauauacgaggacaaggagggcaagcggaacuacgacaccaucccccucaacaucgccgccgagcgccugaaccaacagcugagcccggugcccgagaccaacgaaaacaacacgccccucaaguucuaccuguccccgaacgaccugguguacgucccgagcgaggaggagcggcacuccgggaacaacauucagcucgacaagaaccgcaucuacaagauggugucuuccaccagcaagaggugcuucuucauccaccaccgcguggccaucucccuggucgacaagaaggaguucagcgcccagaacaagauggagcggaguaucgacaacgagcaggucaugaucaagagcgucugcuggaagcugaucaccgaccgcuuaggcaacaucauaaaggugaucaaauga

SEQ ID NO: 8044 - RNA, 4458 nt, Artificial Sequence
  Cas9 variant
augaagaacauccugggccucgaccuggggaccaacagcaucggcugggccaagaucuccaucgacgacaacgggaaguacaucaaggacagcaucaagcugggcucccgcaucauccccaugagccaggacgugcucuccaacuucagcaagggggucacccuuucccagacgagcgagcggaccuccuuccgcggcgcccguaggcugcgggagcgcacccuccugcggcgcgagcggcugcaccgcauccuccaccuccugggcuuccucccgaagcacuacgagaaggcgaucgggugggaccggaacgacaacaagaccuacggcaaguucaucaaccacgccgagccaaagcuggccuggugcaaggacaacaacgggaagaugcgcuucuuauucauggacagcuuccacgacaugcucuccgaguucucugaaaagcaccccgagcugcuggccaacggcaagaagauccccuuggacuggacgaucuacuaccugcgaaagaaggcccuguacaaggccaucaccaaggaggagcucgccuggauccugcugaacuucaaccagaagcgcggguacuaccagcuccggggcgaggaagaccgcgacuccgaggccaacaagaaggaguaccuggagcugaaggugauaggcguggaggccaccggggagaagaaaggcaacgacaucugguacaacauccaccucgagaacggguggaucuaccgacgcagcuccaaaaacccgcugaacgacuggcugggcaaggucaagagcuucaucgugaccacggaccucgacgcggacgggaaccccaagaaggacaaggaugggaacaucaaacgguccuuccgcgcccccagcgagggcgacuggacccugaucaagaagcggaccgagucgcugcucgagaacucagggcagaccgugggccaguucaucuacaaccacauccuggaggagcccagcgccaagauccgcgggaacuucauccgcacgaucgagcggaaguauuacaaagacgagcugaaggccauccucgagaagcagaaggaguuccaccacgagcuguccagcgagucccugcucaccgaaugcgccaaggagcuguacaagcgcaauaucgcgcaccaggagguccugcucaagaagggcaugauccaccuccugcugaacgacauccuguucuaccagcggccgcugaagaucaagaagucccucaucgacaacugccccuaugagaacuacaaguacguagacaagaaguccggcgacaucaaggucaagagcaucaagugcaucgccaagagcaaccccuucuuccaggaguuccgccuauggcaguucgugagcaaccugcggcuguaccgcaaguccgacgacaaggacgugacaagcgagcaccucgugaccacggacgacuacgcgaaccuguucaccuaccugaacaaccggaaggacaucaagcaguccguccuccugaaggaguacuucaagaucaagaaagugaagaccaucaacggggccgaguaccccgugcgcuggaacuacaucgacgacgacaacaagaccuacccuugcaacgagacgcgguacgacaucuugcacgcccucagcaaaaccgagcugaaguccgaguggcugaccccagagcgcaccuaccggcucuggcaccuccuguacagcaucgagucaaaggaggagacgaagaaggcgcugaacaagcugaacuuaagcgacgacuucaccgaggccuuucucaccaucaagcccuucaagaaggaguacggcuccuacagcgagaaggccaucaagaagcuccugucccucaugcgcaugggguaccuguggagcgaggacgaggccaucaagcaggucggcgccgagaucgagaagacuaucgagggggagcugcccgacuacgugcuccagcgguuagagaagucccagcacaacuacaacaagaucagcgacuucagcggccugccgcucuggcuggcguccuacaucaucuacggccgccacucugaggccaaggagaucauccacugggacaacccggaguccaugauggccuacaucaaggacuuccggcagcacagcaugcgcaaccccaucguggagcagugcguccuggaaacgcuccggaccgugcacgacaucuggaaggagaucgggcacaucgacgagauccacaucgagcugggccgcgagaugaaguccaccagcgagcagcggaaggccauaacccagaacguccugcacaaccagaauacgaacauccgcaucaagcuccugcugcaggagcucaagaacgacaacaauaucaccgggguccgccccuauuccccgaugcagcaggagauccugcggaucuacgaggagggcgcccugcaggggcucaccaaggaggacaaggacuauaacgacauccugaagaucagccagaccgcccagcccacguccaacgagcugacccgcuauaagcucuggcuggagcagaaguaccggagccccuauaccggcaaggccaucucccugagcaagcuguucaccuccgccuaccagaucgagcacgugaucccccagagccgauacuucgacgacucccugagcaacaaggugaucugcgagagcgaggucaacacccugaagaaggccaugcucggcauggaguucaucaagacgugcgggggccagaagguacacugcacccugcucggggacguagagaucuacaacgaggaggacuacaaggcguucgugaacgagcacuacuccaauaacagaaccaagcgcaacaaacuccugauggaggacaucccgcaggaguucaucaaccggcagcugaacgacagcagguacaucuccaagauggugaagcagcuccugagcgccaucguccggggccaggaggagguggaggccaccuccaaguucgugauccccugcacgggcgggaucaccgaccgccugaagaaggacuggggccucaacgacaucuggaacaaccuggucagcccccgguuccagcgcaugaacgcccugaccggguccgaguacuucggccacugggagaacaaggaggggaagcggguguuucagaccacgaugcccauccagcuccagcagggcuucagcaagaagcgcaucgaccaccggcaccacgccauggacgcgcuggugaucgccugcgccucccgcaacaucaucagcuaccugaacaacgagaccgcccaggacaccgagcggcgccgggaccucaggcagaagcugugcgacaagggcggguccguucggaagccgugggacagcuucacccaggacacgcaguacgcccugaaggacaucaucgugaccuucaagaacuacgugcgcaucaucaacaaggcgaccaacuacuacgagcacuacaagaccgacggcaagaaggggaugaucagccagaagggcgacgagcucugggccauccgcaagcccaugcacaaggagacggucuucgggaaggugaaccugcggcgccccaagagggugagccuguccaaggccaucgacagcguagacgugaucugcaaccgcaagcucaagaaguacaucaaggcccggcugaacgaggggcugcagaagaagcagauccucaacaucuucaaggaacugaacaacgugugggagggcaucgacgucaacaagaucgacaucugggagauguccaacgacaaggagccaauggucgccacccgcaagcagcuggacaccagcuucgacgagaagaagauccgguccaucagcgacaccggaauccagaagauccuccugaacuauuugaucacgaagaacaacaaccccgagcucgcguucacccccgagggcauccaggagaugaacagcaacauuuccgaguacaacgaccacaaggaacaccagcccauauacaaggugcgcgucaccgagccgcugggggccaaguaccccaucggcaccauggggaacaagcccaagaaguuuguggaggcccaagccggcacgaaccuguacuucgcaaucuacgaggacaaggagggcaaccggaacuacgacaccaucccccucaacaucgccgccgagcgccugaaccagcagcugagcccggugcccgagaccaacgagaacaacacgccccucaaguucuaccugucccccaacgaccugguuuacgugccgucugaggaggagcggcacuccgggaacaacauucagcucgacaagaaccgcaucuacaagaugguguccuccaccagcaagcagugcuucuucauucaccaccgugucgccaucagccuaguggacaagaaggaguucagcgcccagaacaagauggagcgcuccauagacaacgagcaggucaugaucaagagcgugugcuggaagcugaucaccgaccggcucggcaacaucaucaaggugaucaaguga

SEQ ID NO: 8045 - RNA, 4461 nt, Artificial Sequence
  Cas9 variant
augaccaagauccuaggccucgaccuggggaccaacagcaucggcugggcgauccgcgaggacgagaacgaggggguuaaccaaaucaucgacaagggcguccggaucuuuuccgaaggggucaagagcgagaacgguaaggagaucucccgcgccgcagagcggacugccuacagaagcgcccguaagauaaaguacaggcggaaacugcgcaaguacgagacccucaaggugcuguccgugaaugguaugugcccccugagcguggaggaaguggaacaguggaagaaguccggauucaaggaguacccgcucaaccccgaguuccugaacuggcuacgcaccaacgaggauaaaaacaucaauccuuacuucuuccgcgauaaagccucuaagcagaaggucacccuauucgagcugggccgggcccuguaccacauagcgcagcgccggggguuccucuccaaccgccuagaccagucggccgaaggcguguucgaggagcacaacccccagauccagaaccugaucgaggaccuagacuccagcaacacgauucugaacgaacugaaggaauacuacauaaacuuagggaucaucgacgaguccgagaaguccggcuucaagaaggaccuggacgagggcgagaaaaaccugaaaaagcucuauaccucccuagugaguaucaccaagaagaacgccaacgacaucgagacuugcaagcaggagcugaucgcccgguugaacaagaaggaggaccuggggaaagugaagggcgaaaucaaggacaucucccaggccaugcuggacgggaacuucaaaacgcucggccaguauuucuucagccuguacaacaagacccgaauccguaaccaguacacaucccgcgaggagcacuaccuggaggaguucaucaucauuugccagacccaaggcaucgaggagauaaauacgaacgagaagcuccccgagaagaaguucacagggcuggccaaggaccuguaccgggcaaucuucuuccagaggccccucaagagccaaaagggccuaaucgggaaaugcagcuucgagaagaacaagucccggugcgcagugucccaccccgacuacgaagaguuccguaugugguccuaccugaacaccaucaagauuggcacccagagcgagaagacgcuccgcuucuuaacccuggaggaaaagcucaaacuggugccaaaguucuacaggaagaacgacuucaacuucgaagucuuagccaaggagcucguggagaagggggcguccuucggcuacuauaaaagcaguaaaaagaaugaguucuucuauugguucaacuacaagcccacugacucuguguccgcuugcgucgugagcgccucccuggagaacgccaucggcaaagacuggaagaccaaaacuuucgaauaccagaccagcaacaccaagaaggaggaggugaccaaguccgucaacuacaaggaccuguggcaccuccugagcguggcuacguccgacaccuaccuuuaugacuucgcgaucgagaagcucaagcuggagcccaagaacgccaaggccuucagcaaaacuaaacugaaaaaggacuucgccuccuugagccuagccgcgaucgccaagauccugcccuacuuaaagcaggggcuccuguacucccacgccguguucaucgccaauaucgagaacaucgucgacgccgacaucuggaaggacaaggagcagcagaaauucauacagagcaagaucguggaccugauagacaacuaccucguggagaaguccaaguuggagaucaucaacugcuugcucaagaucuacaacaccgaggauauagagggccgcaaggucuacuacagcaaggaggcggagagccuguucgaggccgaccugcggaagaagcuaguccccuucuacaaggccaauacgaucuccgagcagcaggagcaggagauuaucuucaaggaccuguucccgguccugaucgagcaguuaaagaagcaggaguucauuaagaucgugcgccuggauaagaagaucgaggccuuccugaagggcgaaaacgaagagggccagaucuucugcaacuaccccgagaaauucaaaaagcucuaccacccgagcgacaucgaaguguuuaagaagaaaaucaucaaggacgagugggggaacgagaaagucgugcugggcagcccccucaccaccagcauuaaaaacccgauggcgaugcgggcgcuccaccagcugcgcaaggugcugaacacccucauccuggauggccagaucgacgagaagacgcggauccacaucgagauggcgcgcgagcugaacgacgccaacaagcggaaggggauccaggauuuccagaaggagcgcgaggagcucuacaagaucuacgaggccaagaucaaagaacuguaccaggucaaaacagggaaagagcugcuccacgugaccgaugaggaccuccaaaaguucgagugggcacuggagcagaccaaggacgggcggauuaucacgaaggaggagcucauaaaguacaagaucugggaggagcagaaccacaucuguaucuacaccggcaagacgauauccaucgacagcuuccucgggggcaaccccaaguucgacaucgagcauacuaucccccgcuccaucagccaggacaacucccugaugaacaaaacccugugugacaaggacuucaaccguuccgugaagggcaagaagaugcccgucgagcugucgaacuacaacgagauacugccgcgcauugcucacuggaagaagcaggccgaggagcugacgcggcagauagagaccauaagcaggucuaucaaguccgccgcaacaaagguggcuaaggacaagaacauacggaagcgccacuaccuaacccugaagcgcgacuacauccaggggaaauacgacagguucacguggggcgagcccaagguggguuucaagaacucccaaaucccggacaccggcaucaucaccaaguaugcccaggccuaccucaagaguuacuuuaagcgagucgagaguguaaagggcggggccguggccgaguucagaaaacuguggggaauccaggaguccuucaucgacgagaacggguucaagcacuucaaggagaaggaccgcagcaagcacacccaccauacgaucgacgcaaucaccaucgccugcaugcccaaagacaaguacgaccugcucgcccacgccuggcgacuggaggacgagcagaacaagaaggcggccaaggcccugaucgagcaggccaaaccguggaagaccuucaaggaggacaucgagaagauugaggcugagauccucgucagucacuucacccccgacaacgugaagaagcaggcaaagaagauccugcgcgugcggggcaagaagcaguacgucgccgagaucgagcgcaacgccaacgggaaggccauccccaagaaggacgccucuggcaagaucaucuacaagcugaacgagcggggcaacaagaucccgauucuccagcagggggacacgauccgcgguucacugcaccaggauucuaucuacggggccauaaagaacccccugaacaccaacgagauccgguacgugauacgcaaggaccucgaaucccugaaagccaacgacaucgagaacaucguggacgagaacgucaaggccaaggugaaagaggccguugccaacaagauucuguugaucagcaguaacccccagcaaaagaacaaguucgcggagggcaagaacguuuggaugaacgaggagaagaagauucccaucaacaaggugcggaucuacgccaacagcgugaagaauccuaucgagauuaaaaagcacuccacccugaguaagaguaagcaugagcacaagcagacagucuacgggcagaacgaugagaacuaugccauggcccuguacgagcucgacgguaagcgcgaguucgagcucaucaacaacuuuaacuuggcgaagcuccugaagcagggccaaggguacuacccccugcacaaggagaaggagauaaagggcaagaaggugcucauaccgaucgagaagcggaacaaccgcgacgugguccugaagcggggccaacaggucguguucuacgauaagacgguggagaacagcaaagacaucuccgagaucgucgacuuccgcggccggguguacuuaauagaggggcucaccauccagagacaaaaagacaagaagaccggcaagguuaaugaguacggcaucauccagcugagguacuucaaggaagcccgcaagagcgaggagaucuccaaggacagcuucaagcccgacggggaguucaagaucaacgagaacaagccaacccggaaaaugaaccacaaccaauucacggccuucguggagggcaucgacuucaaggugcugcccuccgggaaauuccagaagaucuga

SEQ ID NO: 8046 - RNA, 4464 nt, Artificial Sequence
  Cas9 variant
augaagaacgugcugggccucgaccuggggagcaacuccgucggcugggcccuggugaagaccgaggacaacgggaaccccaucggcagcaucaagauggggucccgcauaauuccgaugagccaggacauccucggcuccuucgagaagggcgacaccgugagccagacggcccagcggacccuguaccgcgggaagcggcgccugaucgagcggcacguccugcgccgggagcgccugugccgggugcugcacaucaugaacuuccuccccgaccacuucgacaagcugcugggcugggacaaaaccgacaacaagaccuacgggaaguucaucgacgacuccgagcccaaacucgccuggcgccagaacaagaacgagaaggagaagauggaguucguguucauggacagcuuccacgagaugcugucugacuucgccaaacaccagccccagcugaucgccaacgguaagaaggucccgcucgacuggacgaucuacuaccugcggaagaaggcccugacccagcucaucagcaaggaggagcuggccuggauccugcucaacuucaacaagaagcgcggguacuaccagcugcggggcgaggaggaagaggagcagcccaccaagaaggaggaguacaaggugcugaaagugaucuccgucgacgcggacgagggccagaagggaaacggcaucugguacaacauccaccucgaggacgggggcaucuacaagcgcaagagcgacacgccccuguacgacugggugggcaagacccugcaguuaaucguggucaccaucuacgaaaaggacgggaagacccccaagaucuucgacuccggcaagcagaacccgagcuaccgucugcccaaggaggacgacugggggcugaucaagaagcgcaccgagucucagauccagagcuccggcaagacggugggggccuucaucuacgacaacauccucucaaagcccgacgacaagauccgggggaaccuggugcgcacaaucgaacggaaguacuacaagaaggaacugaucgagauccuccagcagcaggccaaguaccacgacgagcugcacaaccagaaccugcucgaguccugcgccaaggagcuguacgcgcacaacgacguccgcuacaacgagguggucaagagcaacaugauccaccuccugguggacgacaucaucuucuaccagcggccucucaagagcaagaagucgcugaucgccaacugcaaguacgagagcuacgaguacguggacaaggagaccggcgaggugaaggagaugccgaucaagugcauagccaaguccaaccccuacuaccaggaguuccgccuguggcaguucauccauaaccugcgccugagcgacgucgucacccgggaggacgugacggcgcaguaccucuccacgccacaggacuacugcaaccuguuuaccuaucugaacgaccguaaagagaucaagcaagacauccuccugaaggacuucuucaagaucaagaagguacagaucgacaaggagaagguguuccccaucgaguggaacuacaucaaggacgccaccaaaaccuacccaugcaacgagaccagauacgaacugcuguccgcgcucaagcgcgccgggauggacaagcaguggcuggacgacacacccaacaugcaguaccggcuguggcaccuccuguacagcgucgaggagcaggaggagagcgccaaggcccugcgcaagcucuacgauaaugacaacuucguguccagcuuccugaagaucaagcccuucaagaagugcuacggcgccuacuccgagaaggcgaucaagcggcugcucacccugaugcgcauggggaaggccugggacgagcaagcaaucgacgccaagacgcugaagugcauccagcagaucaucaccggaaacaucgacagcaagcucaaggagaagaucgacgacucccgguacguccugcaucacgucagcgacuuccaggggcugcccaccuaccucgccuccuacgugaucuacggccgccacagcgaggugaccgacauccggugcugggacacgccgaaggaccugcugaaguucaucuguggcuucccccagcacucccuccgcaaccccaucgucgagcaggucauccucgagacccugcgggugguguacgacaucuggaaggcggagaagcauaucgacgagauccacguggagguggcccgcgagaugaagcucaccgcgcagcagcggaacgaggcaaaccugcgcaaccugaacaacgaggccaccaaucuccggaucaaguaccugcuggaggagcucaagaacgacacguucaucaaggacguccgcccccugagcccgaugcaccaggaaaagaugagaaucuacgagcaggcggugcuggggaaccucaacaagcaggauaaggacuacgacgacaucaucaagaucuccaagaaggagcgccccaccagcgcugagcugauccgcuacaagcuguggcucgagcagaaguacugcagccccuacaccggcaaggccaucucccugagcaagcuguucaccacggccuaccagaucgagcacgugaucccccagucccgguacuucgacaacagcuucaacaacaaggucaucugcgagucugaggugaacaaggagaaggacaagaugcucggguacgaguucaucaagggccgcgggggcgaccguaucuacugcaccgcgcacggcaaagaggugaccauccugaaggaggaggaguacaagcaguucgucaacgagcacuacgcccacaacaagcgcaagcgggacaaccugcucgccgagaacaucccggagagcuucuccagccgccagcugaacgacacccgguacaucaccaagacgaucaugucccugcucagcaacguggugcgccagcagggggaggaggaggccaccgccaagaaccugcugcccuccagcggcgccguaaccgacaagcucaagaacgacugggggcugaaggacguguggaacaccaucgugacgccccgguuugagcgccugaacaagcucuccggcaccaacgauuucggcgagaugaaggaggagaacgggaauagauauuuccagaccaacgucccgagcgaguacgagaagggcuucaagaagaagcgcaucgaccaccggcaccacgccauggacgcccuggugaucgccugcaccacgcgcaacauggugaacuacaucuccaacgucaacgccaacagccccaagcagcgggaggaccugcgccagcuccugugcgacaagaaccggaucaucaacaagcccuggaacaccuucacccaggacgcgcugaaggcccucaacgacaucgugguguccuucaagaacaacguccggaucaucaaccgggccaccaaccgcuaccagcgguacgacaagaacgggaagaagaugaucugcagccagaagggcaacgacaugugggcaauccgcaagagcaugcacaaggagacuguguucgggcgcgugaaccugauccggaaggaggcccugcccaucgcgaaggcccucgacaacaucuccgccaucugcaacgcccaguuacgcgcguacgucaacgaccugguggacaagcacuucaacaagaagcagcucguggcccacuucaagagcuuagacuacaaguggaaccggcaggacgucuccaagguggagguguggaucucuuccgacgacaagacaccaauggucgcugugcgaaagccccuggacaccagcuucgacaagaagaagaucgccuccaucaccgacacgggcauccaggccauccuccugaacuaccuggagagcaaagguggggacgcccucguggccuucgcccccgagggcauccaggagaugaacuccaauaucgagcuguauaacaacgggaaggcccacaagcccauuaagaacguccggcugagcgagacccucggcgccaaguaccaggugggggagcgcggcgcgaagaccaagaaguacguggucgccgauaaaggcaccaaucuguucuucgcgaucuaugaggacgaggaggggaagcgguacuacuacuccgugccgcugcgcgaggccaucgagcggcaaaagcagaagcucagccccgugcccgaguacaacgagaagggcgucgcccugaaguucuaccugucccccaacgaccucguguacgugccgacggaggaggagcgcaccauggggaccugccacauagacaagaccagaaucuacaagaugguaagcuccagcgagaaccgcugcugcuucgugcccuccacgaucgcgaaggucaucgccgacaagguggagcuguugucacacaacaagaucgagaaggccaucaccggcgaguccaucaaggaggugugcuggaagcucaaggucgaccgacugggcaacauccugaacgugaucaaguga

SEQ ID NO: 8047 - RNA, 4464 nt, Artificial Sequence
  Cas9 variant
augaagaacguccugggccucgaccuggggagcaauuccgucgguugggcccuggugaagaccgaggacaacgggaaccccaucggcagcaucaaaauggggucccgcaucauuccgaugagccaggacauucuaggcuccuucgagaagggcgacaccgugagccagacagcccagcggacccuguaccgcgguaaacggcgccuaaccgagcggcauguccuccgccgggagcgacugugccgggugcugcacaucaugaacuuccuccccgaccacuuugacaagcugcugggcugggacaaaaccgacaacaagacguacgggaaguucaucgacgacucugagcccaagcucgcguggcgccagaacaagaacgagaaggagaagauggaguucguguucauggacagcuuucacgagaugcuguccgauuucgcaaagcaccagccccagcuuaucgccaacggcaagaaggucccacucgacuggaccauauacuacuugaggaagaaggcccugacccaguugaucagcaaggaggagcuggccuggauccugcuuaacuucaacaagaagcggggguauuaccagcugcggggcgaggaggaggaggagcagcccaccaagaaggaggaguacaagguacugaaggugaucuccgucgacgcggacgagggccagaaagguaacggcaucugguacaacauccaccucgaggacggcggcaucuacaagcgcaagagcgacaucccccuguacgacugggugggcaagacgcugcagcucaucguugucaccaucuacgagaaggacgggaagacccccaagaucuucgacuccggcaagcagaauccuagcuaccggcugcccaaggaggacgacugggggcugaucaagaaacgcaccgagucccagauccaaagcuccggcaagacggugggggccuucauauacgacaacauauugagcaagcccgccgacaagauccggggcaaccugguucgcaccaucgagcggaaguacuacaagaaggagcugaucgagaucuuacagcagcaggccaaguaccacgacgagcugcacaaccagcaccuccuggaauccugcgcgaaggagcuguacgcccacaacgacguucgcuacaacgagguggucaagucaaacaugauccaccuccugguugacgacaucaucuucuaccagcggccccucaaaagcaagaagucccugaucgauaacugcaaauacgagagcuacgaguacguggacaaggagacaggcgaggugaaggagaugccgaucaagugcaucgccaaguccaaccccuacuaucaggaguuccgccuguggcaguucauccacaacuuacgccuaagcgacgucgugacccgagaagaugugacggcccaguaccucuccacgccccaggacuacugcaaccuauucaccuaccugaacgaccgcaaggagaucaagcaggacauccuacugaaggacuucuuccagaucaagaagguccaaauugacaaggagaagguguuccccaucgaguggaacuacaucaaggacgccaccaagaccuacccgugcaacgagaccaaguacgagcugcugucggcgcucaagcgggccgggauggacaagcaguggcuggacgacacccccaacaugcaguaccgccuguggcaccuccuguauuccgucgaggagaaggaggagucugccaaggcccugcggaaacuuuaugacgacgauaacuucguuuccuccuuccugaagaucaaacccuucgagaagugcuacggcgccuacuccgagaaggcgaucaagcgcuuacucacccugaugcggaugggcaaggcaugggacgagcaggccauugacgccaagacgcugaagugcauccagcagaucaucaccggcaacaucgacagcaagcucaaagagaagaucgacgacucccgcuacgugcugcaccacgucagcgacuuccaggggcugcccaccuaccucgccuccuacgugaucuacggccggcacagcgaggugaccgacaucagaugcugggacacgccgaaggaccuccugaaguucaucuguggcuucccgcagcacucccuccggaaccccaucgucgagcaagucauccuggaaacccugcgcgugguguacgacaucuggaaggcggagaagcacaucgacgagauccacguggagguggcccgggagaugaagcucaccgcacagcagcgcaacgaggccaaccugcggaaccugaacaacgaggccaccaaccuccgcaucaaguaccugcuggaggagcucaagaacgacacguucaucaaggacguccgcccccugagcccgaugcaccaggagaagaugcgaaucuacgagcaggcggugcuggggaaucucaacaagcaggacaaggacuacgacgacaucaucaagaucuccaagaaggagcggccuaccagcgccgagcuuaucagguacaagcuguggcucgagcagaaguacugcagcccguacaccggcaaggccaucucccugagcaagcuguucaccacggccuaccagaucgagcacgugaucccacaguccagguacuuugacaacagcuucaacaacaaggucaucugcgaguccgagguaaacaaggagaaggacaagaugcucgguuacgaguucauuaagggcagagggggcgaccggaucuauugcaccgcgcacggcaaggaagugacgauccugaaggaggaggaguacaaacaguucgucaacgagcacuacgcccacaacaagcggaagcgcgacaaccugcucgccgagaacaucccggagagcuuuuccagccggcagcugaacgacacccgcuacaucaccaagacgaucaugucccucuugagcaacguggugcggcagcagggggaggaggaggcuaccgccaagaaucugcugcccuccucgggcgcggugacggauaagcucaagaacgauugggggcucaaggacguguggaacaccaucgugacgccccgcuucgagcggcugaacaagcucuccggcaccaaugacuucggcgagaugaaggaagagaacgggaaccgcuacuuccagaccaacgucccgagcgaguacgaaaagggcuucaagaagaagcggauagaccaccgccaccacgccauggaugcccuggugaucgccugcaccacgcggaacaugguaaacuacaucuccaacguaaacgccaacagccccaaacagcgcgaggaccugcggcagcucuuaugcgacaagaaccgaaucaucaacaagcccuggaacaccuucacccaggacgcgcuuaaggcccuaaacgacaucguggugucuuucaagaacaacguccguaucaucaaccgcgccaccaaccgguaccagcgcuaugacaagaaugggaagaagaugaucugcagccagaaaggcaacgacaugugggccauccgcaagagcaugcacaaggagacgguguucgggcgggugaaccuuauccgcaaggaggcccugccuauagcgaaggcccucgacaacaucuccgccaucugcaacgcccagcugcgggcguacgucaacgaccugguggacaagcacuucaauaagaagcagcucguggcccauuucaagagccuggacuacaaguggaaccgccaggacgucuccaagguggaaguguggaucagcuccgacgacaagaccccgauggucgccgugcggaagccccuggacaccagcuucgacaagaagaagaucgccuccaucaccgacacgggcauccaggccauccuccugaacuauuuagaguccaagggcggggacgcgcuaguggccuucgcccccgagggcauccaagagaugaacucuaacauugagcuguacaacaacgggaaagcccauaaacccaucaagaacguccgcuuaagugagacccucggcgccaaguaccaggugggggagcggggcgcaaagaccaagaaguauguggucgccgacaagggcaccaaccuauucuucgcgaucuacgaggacgaggaggggaagcgcuacuacuacuccgugccgcugcgggaggccaucgagcgccagaagcagaagcucagccccgugcccgaguacaacgagaagggcgucgcccugaaguucuaccugucccccaacgaccucguguacgugccgaccgaagaggagcggaccaugggcacuugccacauagacaagacccgcauauacaagauggucagcuccagcgagaaccggugcugcuuuguuccuuccacgaucgcgaaggucaucgccgacaagguggagcugcugagccacaacaagaucgagaaggccaucacuggcgagucaaucaaggagguguguuggaaacucaaggucgaccgccuggggaacauccugaacgucaucaaguga

SEQ ID NO: 8048 - RNA, 4464 nt, Artificial Sequence
  Cas9 variant
augaagaacauccugggccuagaccuggggagcaacuccgugggcugggcccuggucaagguggaggagaacgggaaccccaucggcagcaucaagauggggucccgcaucaucccgaugagccaggacauccucggcuccuucgagaagggcgacaccgugagccagaccgcccagcggacgcuguaccgcgggaagcggcgccugaucgagcggcacguucuccgccgggagcgccugugccgggugcugcacaucaugaacuuccuccccgcgcacuucgaccgccugcugggcugggacaagaccgacaacaagaccuacgggaaguucauagacgacuccgagcccaagcucgccuggcggcagaacaagaacgagaugggcaagauggaguucguguucauggacagcuuccacgagaugcuguccgacuucgccaagcaccagccccaauugaucgccaacgggaagaaggucccgcucgacuggaccaucuacuaccugcggaagaaggcccugacgcagcucaucagcaaggaggagcuggcguggauccugcucaacuucaacaagaagcggggcuacuaccaguuacgcggcgaggaggaggaggagcagcccaccaagaaggaggaguacaaggugcugaaggugauuuccgucgacgccgacgaggggcagaagggcaacgggaucugguacaacauccaccucgaggacggcggcaucuacaagaagaaguccgacaucccccuguacgacuggguggggaagacccugcagcucauaguggucaccacguacgagaaagacggcaagacccccaagaucuucgacagcgggaagcagaacccgagcuaccggcugcccaaggaggacgacuggggccuggugaagaagcgcaccgagucccagcuccagagcuccgggaagaccgugggagccuucaucuacgacaacauccugagcaagcccgacgacaagauccggggcaaccugguccgcacgaucgagcggaaguacuacaagaaggagcucaucgagauccugcagcagcaggccaaguaccacgacgagcugcacaaccagaaccuccuggagucaugcgcgaaggagcuguacgcccacaacgacgugcacuacaacgaggugauaaagagcaacaugaucaaccuccuggucaacgacaucaucuucuaccagcgcccccucaagagcaagaaauccuuaaucgccaauugcaaguacgagagcuacgaguacguggacaaggagaccggggagauaaaggagaugcccaucaaguguaucgccaaguccaaccccuacuaccaggaguuccggcuguggcaguucauccacaaccugcgccucagcgacguggucacccgcgaggaugugaccgcccaguaccuguccacgccccaggacuacugcaaccuguucaccuaccucaacgaccggaaggagaucaagcaagacauccuccugaaggacuuuuucaagaucaagaaggugcagaucgacaaggagaaggucuucccgaucgaguggaacuacaucaaagacgcgaccaagagcuauccgugcaacgagaccagguacgaguuacucuccgcccugaagcgagccggcauggacaagcaauggcuggacgacacgcccaacaugcaguaccgccucuggcaccuccuguacagcguggaggagaaggaggaguccgccaaggcccugcggaagcuguacgacgacgacaaguucgucaccagcuuucugaagaucaagcccuucaacaagugcuacggcgcuuacuccgagaaggccaucaagcgccuccugacccugaugcggaugggcaaggccuggaacgagcaggccaucgacgccaagacccucaaaugcauccagcagaucaucacggacaacguggacagcaaguugaaggagaagaucgacgacucccgcuacgugcugcaccacgucuccgacuuccaggggcuccccaccuaccuggcguccuacgugaucuacggccggcacagcgaggugaccgauauccagugcugggacuccccagaggaccugcucaaguucauccgcgacuucaagcagcacagccugcggaaccccaucgucgagcaggucauccuggagacccuccgcgugguguacgacaucuggaaggccgagaagcacaucgacgagauccauguggaaguggcccgggagaugaaacugacggcccagcagcgcaacgaggccaaccugcggaaccucaacaacgaggcgaccaaccugcgcaucaaguacuugcucgaggagcugaagaacgacaccuucaucaaggacguccggccccugucccccauccaccaggagaagaugcgcaucuacgagcaggccgugcucggcaaccugaacaagcaggacaaggacuacgacgacaucaucaagaucagcaagaaagagcauccgaccaacgccgagcugaucagguacaagcuguggcuggagcagcgcuauugcagccccuacacggggaaggccaucucccugagcaaguuauucaccaccgcguacgagaucgagcacaucaucccucagucccgcuacuucgacaacagcuucaacaacaaggugaucugcgaggccgaggucaacaaggccaagggcaacaugcucggguacgaguucaucaagaagcagggcgggcagaagaucuacugcacccagcugggcaaagccgugacgauccucaaggaggaggccuacaagcaguucgugaacgagcacuacgcgcacaacaagcggaagcgcgacaacuugcuggccgagaacauccccgaguccuucucgucccgccaacucaacgacacccgcuacaucaccaagaccaucaugagccugcuguccaacgucguacggcagcagagcgaggaggaggccaccgccaagaaccuccugccguccagcggcuccgugacggaccgccugaagaacgacugggggcucaaagacgucuggaacaccaucgugacgccccgguuugagcgccugaacaagcugucugguaccaacgauuucggggagaugaaggaggagaacggcaaccgguacuuccagaccaacgugccccucgaguacgagaagggcuucaagaaaaagcgcaucgaccaccggcaccacgcuauggacgcgcuggucaucgccugcaccacccgcaacauggugaacuacaucuccaacgccaacgcaaacagcccgaagcagcgggaggaccugcgccagcuccugugcgacaagaaccggaucaucaacaagcccugggacacguucacgcaggacgcccugaaggcgcucaacgacaucguggucucuuucaagaauaacgugcgcaucaucaaccgggccaccaaucgcuaccagcgguacgacaagaacgggaagaagaucaucuucagccagaagggcgacgacaugugggccauccgcaagagcaugcacaaggagaccguguucggacgggucaaccugauccgcaaggaggugcugcccaucgccaaggcgcuagacaacaucuccgccaucugcaacgcccagcugcgcgccuacgugaacgaccuggucgacaagcacuucaacaagaagcagcucguggcccacuucaagagccugaacuacaaguggaaccggcaggacguguccaagguggagguguggaucagcuccgacaacaagacccccaugguggcgguccgcaagccgcuggacacgagcuucgacaagaagaagaucgccuccaucaccgacaccggcauccagaccauccuccugaacuaccuggagagcaagggcggagacgccuccguggccuucgcccccgagggcauccaggagaugaacagcaacaucgagcucuacaacaacgggaaggcgcacaagccaaucaaaaacgugcggcuguccgagccccugggcgccaaguaccaggucggggagcgcggcgccaagacgaagaaguacguggaggccgacaaggggaccaaccucuucuucgccauuuacgaggacgaggagggcaagcgguacuacuacucagugccgcugcgcgaggcgaucgagcggcagaagcagaagcugucccccguccccgaguacaacgagaaggggguggcccucaaguuuuacuugucccccaacgaucugguguacgucccgaccgaggaggagcgcaccauggggacgugccacaucgacaaggcccggaucuacaagaugguguccagcaccggcugcuccugcuacuucgugcccagcaccuucgccaaggucaucguugacaaggucgagcuccagucccugaacaagauggagaaggcaaucaccgacgagugcaucaaggaggugugcuggaagcugaagguggaccgccuugggaacaucaucaacgucaucaaguga

SEQ ID NO: 8049 - RNA, 4485 nt, Artificial Sequence
  Cas9 variant
augaagaauauccugggccucgaccuggggaccaacagcauaggcugggcccugaucgacaacgagagccaccgcaucaucaagagcgggucccggaucauucccauggacgccgcgaccaugggcgacuacgagaaggggaaucucaaaagcgcagacuggaagcgcacguccuuucgcggcaugcgccggcuauacgagcgcgccaagcuacggcgcgagcgguuguuacgcgugcugaacauccucggcuuucugccggaggaguuccgccgccagaucgacuucgagcaccaccccgggcaguucaucgacggcaaggagccccugaucgccuaccaccacgacgagaacgggcagcgugucuucagcuacauguccgccuucgaggaaaugcucaccgacuuccgcgcgacccagucagagcuggugcgagacggccgccgcgugccguacgacuggaccaucuacuaucugcgccacaaagcccucacgcaaccggucaccaaggaggagcuggccuggaucauccugaacuucaacaccaagcggggguacuaccagcuccgauccgagagcgaggaagugaccacgaacaagaacgaagaguacgccgagcugaagguggucuccguggagaagaccggcgaggacaagaagcgggcgggcuacuacugguacaccaucaccuacgacaacgaggccgagcagaaaaucacgagcaccaucccgccccgccaaaucggggacaagguggagcugaucguuaccacugcccgcgacaaggccggcgagauaaagaagucugugcggagccccaaggaggacgacuggacgcucaugaagaaacgcaccgagcacaacaucgaggaagaggagugcaccgugggguccuacaucuaccagcacauccucgccgacccaaccgucaaagugcggggcaagcuggugcacacgauugagcgcaaguucuacaagaaggaguugaagcagauucugaacaagcagaaggaguucauccccgagcugcaggacgcgagucucuacgaggcuugcaucaaggaacuuuacagaaacaacgaggcccauauccaauccauugccaacaaggacuucaccgaccucuucgucaacgacauaaucuuuuaucagcgcccccucaaaagcaagaaguccaccauuagcaacugccccuacgagagcuacuacuacaagaacaaggaaaccggcgagcugauccggaaaccgaucaagugcaucgccaaguccaacccccuguaccaggaguuucgccucuggcaguucgugcacaaccugcggaucuacaagaaguccgaggaaguuagcgggcgccugcagacggacguagaugugaccgaccgguuucuuacaacccccgacgacuacgcgaaacuguucagcuggcugaacgaccgcaaggagauaaagcagaaggagcuccugcgguacgaggccuucggccuguccaagagcuacggggacuaccgcuggaacuucguggaagacaagcccuacccgugcaacgaaacgcuccacgagaucaaccggcgcaugaaguccauccugagcgauaagaagcuguccagcgaggccuaccagcagcucuggcacauccuguauuccaucgacgaccccaucgagauccggaaggcccugaccagcuuugcccagaaccaggaaaucaacuccgacgacuucgucaacgcguucuaccaguacgugcccgagaagaccaagagcuacggcgccuacuccgagaaggccaucaagaagcuccugccccucaugcgccggggguccuacugggccaucggcaacaucgacgagaagacccaccgccgccuggacaauaucaucaacggcguggccgacgacagcaucagcacguguacacgggagaagcucaacaaccugaccgacaucaccaugugccagggcaugccgcuguggcaggcgugcuacgccgucuacgaccgccacuccgaggccgccgacacaaccaagugggagcagccagaugacaucgacaccuaccucagcaccgagcugaagcagcacagccugcgaaaccccaucguggagaccgucaucuccgagacgcuccgcguugugcgggacaucuggaaggcguacggccgccccgaggaaauccaugucgagcuggggcggaaccugaagcaggacgccaagagccgaaagcaggaugccauccgcauggccgaaaacgagcagaccaaccuccgcauccgggcccugcugcaggagcucuccaacccggagugcggcguggagaacguacguccccacagccccucccagauggagcugcugaagaucuacgagaacgagguccuccagagcaccgacgacauccccgaggagaucuccaacaucauaaaggaccuggggaaaaccgacagcaagaagcgaccgucccugagcgacaucacaaaguaccgccucuggcuggagcagaaguaccaguccccuuacaccggccacaucaucccccugagcaagcuguucaccccggcguaccagaucgagcacgugauaccccagucccgguacuucgacgacagcaucuccaacaaggugaucugcgaggccgaggucaacaaggagaaggaccgcaugcugggcuacgaguucaucaucaauaagggcgggagcaucgugaaggggucauucggccagcaguucaagaucuucgacaaggugcaguacgaggacuucgucaagcagcgguacgcccacaacaagaccaaaaugaaaaagcugcucauggacgacauccccgacggguucauccagaggcagcugaacgacagccgguacaugagcaagaagauaaucuccauccugagcaacaucgugagggaggacggcgaaaaggaggccacguccaagcacaucaucgugaccagcggagccaucaccgaccggcucaagaaggagugggggaucaaggacgucuggaacgacaucaucgcgccccgcuucaagcgccugaacaagcugaccgacuccaacaacuacggcauggagacggagaaggaggggcggcaguacuuccagaucaacgugccgaccgaguugagcaccggccugaucaagaagcgcaucgaccaccggcaccacgccauggacgccaucaucaucgcgugcaccacccgcaaccacgugaauuuccugaacaacuccaccgccgcgagcgaccagaaggacauccggcgcgaccuccaacacacgcugugcacuaagacgaagaccgacuccaacggcaacuacgucuggcgguucaauaagcccugggacaccuucacccaggacacgcgccaggaacuggaggggaucaucgugagcuuuaagcagaaccucagaaucaucaauaaaauguccaacuacuaccagcacuacguggacggccggaagaccauaagccggcagaacaagggggauggcugggccauccgcaagucccugcacaaggccaccgucagcgggaaggugaaccugaagagguccaagaccgugggcuucaaggaggcccucaaugacugguccgcgaucaaggacaaaacguccaaggccauccugcagaagauaaucgcccaguacaagaacuacgaccccaagaccauuuucaaguacuucaaggaucgcaacuuuaaggucgagggcaaagacuucagcaagcuggagguguacuacaacaccucggacaaggagcccaugagcgcacaccgugugaauaucgacaccacguucgacgagaaggagauccgcagcaucaccgacaccggcauccagaagauuaugcuaaagcaccuccacacuuacgacgacgcccagggcaagacgcacccggaggcggccuucucccccgaggguaucgagaagaugaaucagaacauccgaaugcuaaacggcgggaaggaucauaagcccaucuucaagguacgcaaggcagagauccucggcaugaaguuugccgugggcgagcgggggcacaaggacaagaaguggguggaggccgacaagggcaccaaucuguucuucgcgaucuacgagagcgaggagaacaagcgcucauacagcuccauaccccugaacgaggccaucgaccgccucaagcgcggggaaaacaucgccgacgagcgggaccaaaacggcaacaagcuacuguucguccucucaccgauggaccugguguacgugcccgaccccgacgacgcccauaucgacgaggucaaagggaacaacaacaucuuuaagauggugagcuguaccgguaccgagugcuacuucgugcccgagaccuacgccaacgucaucugcaagggcaaggagcuggagagcaagaacaagguggaguccuacgacgggaucaacaucaagaaauccugcuauaagaucacgguggaccggcucggcaagguccgcaagaucuucaagggguga

SEQ ID NO: 8050 - RNA, 4491 nt, Artificial Sequence
  Cas9 variant
augaagaccauacugggccucgaccuggggaccaacagcaucggcugggccaaggugugcgucgacgacaacgggaacuaccugcgagacaucaagcucggcucccggaucaucccgaugagccaggacgugcuggggaacuuugacaagggcguuacggaaucccagaccagcguccgcaccggcuuccgcggggugcggcggauccgcgagcggucccugcuacgccgggagcgccugcaccgggugcugcacguccucggcuaccugccgccccacuacgacagugccauaggguggaacaagaacgagcccuccaccuacgguaaguuccugaaucacggcgagcccaagcucgcgugggagcauaaggaggacggcuccaugagauuccuguucauggaguccuuccacgagaugauggccgacuucgccaagagccagccgucccuggugucagauggcaagaagaucccccucgacuggacgaucuacuaccuacggaaaaaggcccugucccagcccauccgcaaggaggagcuggccuggcugcugcucaacuucaaccagaagcggggguacuaccagcugcgcggcgaggaggacgacgacaaccccaccaagugcgaggaguacuacgagcucaagguggucgggaucgaggcggacgaggagggaaagaacggcaacaccugguacaacgugaagcuggagaauggguggauuuaccggaggcagagcaagaucccgcuggacgacuggaucggcaaggugcgggaguucauagucaccacggaguacgagaaggacgggaucacguugaagaaggacaagaacggcgacgugaagcgcucuuuccggagccccuccgaggacgacuggggacuccgcaagaagcgcacugagaagcugcuggacagcuccaagaugaccgugggcgccuucgucuacgaccaccuccuggccgagcccagcgacaagauccggggcaaguucauccgcacgaucgagcggaaguacuacaagaaagagcuguacgccauccucugcgagcagagcaaguaccacgaggagcugcgcuccggggacuaccugaacaagugcgcggaggagcucuauaagaacaaccagccccaccggaacagccugcugaccaaggaccuggccuaccugcugcucgaggaccugaucuucuaccagcgcccccugaagaccaagaagucccucaucgcugagugucccuacgaggccuacaaguacguugacaaggagaccggcgaaaucaaacggcagggcaucaagugcaucgccaagagcaaucccuauuaccaggaguuccgucuguggcaguuuaucuccaaccugcgccucuucaacaaggcggacgacaaggaggugacggccgacuaccugcccacccaggacgacuacguccggcuguucgcguaccugaacgaccggaaggagaucaaccaggagacccuccugaaggaguucuuuaagcugaagaagaucaccgugaacagcgagaagguguucccgauccgcuggaacuacaucgaagacaaggagaagaaguaccccugcaacgagacgcggcacgaguugcugcuggcccucgaccgcgcccggaucgaccacuccuggcuggagaagcccggccaggaauaucgccuguggcaccuucuguacagcguagaguccaaggaggagaccaaggaggcgcugcggaagcucaaggacgacgacgccuucguggagagcuuccugaagguuaagcccuucaagcgcgaguacggggccuacuccgaaaaagccauaaagaaguuacucgccguaaugcggaugggcagccuguggcgcgagacggacauaugcgacaccacgaagggcaacauaaccaagauccugcaaggggagaucgacgagaagcucaaggagaagaucagcgcgagcguguccagcuauaaccagcuguccgacuuccaggggcugccggucugguuggccuguuacgugguguacgggcgccacagcgaggccgccgagauccagcacuggaagacccccgagucccuguuggccuacaucaauggcuucaagcagcacagccuccggaaucccaucgucgagcagugcaucuuagagacccugagaacggugcacgacaucuggaaggagguugggcacauagacgagauccacgucgagcucggccggaacaugaagucgaccgcggaucagcgcgcccggaucagcgagaacgugcugcgcaacgagaacaccaaccuucggaucaagagccuccugcuggagcucaagaacgaccccaacauaaaggacgugaggccguacuccccuaugcagcaggagaagcuacggauauacgaggagggcgucuugcaggagcucaccaaggacgacaaggacuucacggagaucaccaagauuagcaccauggcccagcccuccgccaaggagcuccagcgcuauaagcuguggcucgagcagaaguaccggagccccuacacgggcaagagcaucagccuuacgaagcuguucaccuccgcguaccagaucgagcacgugaucccgcagagccgcuacuucgacgacuccuucuccaacaaggugaucugcgaguccgaggucaacagccucaaggacaacaugcugggguacgaguucaucaagaaccacgggggcgaaaucauccacugcaccaugcugggcgacgugaaggugcucucugagagcgaauacaaggccuucgugaacgaccacuacgcccacaacaaacggaagcgcgagaaccugcugcucgaggacauaccccaggaguuucuaaaccggcagaugaacgacucccgcuauaucagcaaggucgugaaggcccugcucagcaacaucguccgggccgaaggcgaagaggaggcgaccuccaaguucguggugagcugcucaggcgggaucaccgaucgccuuaagaaagacugggggcugaacgacguuuggaacaagaucguguacccccgguucgagcgccucaaccgacugacagggaccgaggccuucggccagugggagaacaaggacggcaaacgcguuuuccagaccgccgucccgcuggagcuccagcgcggguucaauaagaagcggaucgaccaccggcaccacgccauggacgcccuggugaucgcgugcaccagccggaacaucaucaacuaccugaacaacgaguccgccaacaaccccaagaagcgcgaggaccuucggcagaaacugugcgacaagaaccgcacgauccggaaaccgugggaaaccuucacccaggacgccaccgccgcccuggaggacgugauagucagcuucaagaacuacgugcgcaucaucaacaaggccacgaacuacuacgagcgguacgacguggagggcaagaaggucaucgccgagcaacgcggugacgacaugugggccauccggaagccaaugcacgaggccaccuacuacggacgcgugaaccuccggcgcaagaagaaggugaaccugcgggucgcgcuggagaacaucucuagcaucugcgacaacaagcuccgcauuuacaucaacgggcugguggagaagggcuucaacaccaagcagauccuggacaaguuuaagaacacgaacgaccacuucuccaugcagaagaucgauaagguggagaucuggcaguucacgaacgaggaggagaagcucgucgccacccggaagccucuggacaccuccuucgacaccaagaagaucgccuccaucacggacaccgguauccagaccauucugcucaacuaccuggagaccaagggcggcgacagcacgauugccuucacccccgaggggaucguggagaugaaccagaacaucuccaaguacaacaacgguaaggagcacaugcccauucugaaaguacgccucuacaccaaguuagggaagaagauucccgucggccagaccggcugcaaggccaaacaauucguaaucgcggaggccggcaccaaucuguacuucgccaucuacgaggacgaggagggcaagcguagcuaccgcaccauaccgcuuaacgaaguggucgaacgccugaagcaggggcugucccccgugcccgagaagaacgacaaggacguucaccucaaauuuuaccugagccccaaugaccuggucuacgugccgaucgaggacgagcacgaguccuuggccaaggaccacaucuauaaguuuguggacagcuccggcaccaccgccaacuucauuccucaccggagcgcgaacgucaucuucgagcugaacaagaaggacgccgagaaguucugcagcggguccaucauccagaacgaguacggcgugggcucaucccagagcaagaaccagaaggccauuacgggggagaugaucaaggccgugugccgcaagcuggaggucgaccggcucggcaacgugaucaaggucauuuga

SEQ ID NO: 8051 - RNA, 4497 nt, Artificial Sequence
  Cas9 variant
augaagcacauccugggccucgaccuggggaccaacagcaucggcugggccgugauccgcgcccaccaggacgcggacgggcacaccacgcugcaggacauccucgccgccggcucccggaucauccccauggacgccgccacccugacugacuucgacaaggggaacgcgcgcagcggcaccgccgagcggacguccuuccgcagcaugcggcgccggcgcgagcggcagcugcugcgccgggagcgccugcaccggguccugaugcuccugggguuccugccgcagcacuacgccaacucccucaccagguacggggaguucgccgacaaccgggagugcaagcugcccugggugaaggacgagagcgacggcaaguaccacuuccuguuccaggacgcguuccacgagaugugcgaggacuuucgccagcucgcgccccaguggguggccgacgggaagaagguccccuacgacuggacccuguacuaccugcggugcaaggcccucucccgaaagaucagcaaggaggagcuggccuggaucuuacucuccuucaaccaaaagcggggcuacuaccaggcccgcgacgaggaggacgaggugaccacgaacaagcuggaggaguacuacgccgggaaggugguccggguggacgacaccggcgagcgcaaggggaagaacguguacuacgacaucacccuggagaacgggugggucuaccgcuacgccgcccggaucuacccggacugggugggccaggugaaggaguucaucgucaccacgacccucaaccccgacgggacccccaagaccgacaaggccggcgaggugaaacguagcuuccggaugcccaaggacgacgacuggacgcuaaucaagaagaagaaggagcgcgacaucgaccggucccaggagaccaucggccaguacaucuaccacgcgcugcucaaggacccgagccagaagauccgcgggaagcugaucggcaccguggagcggaaguacuacaaggacgagcugcgccggauccucgaccgccagauccaguuccaccccgagcugagggaccgcgagcuguacuacgccugccuccaagagcuguaccccuccaacgucgccuuccggaacacccuggugaaccgcgacuucacguaccucuuccuggacgacauccuguucuaccagcggccccucaagagcaaaaagagccagaucagcgacugcccguacgaggagcacuucuacaccgacaaggagaccggggagcgcaucuccgugcccgucaagugcaucgccgugagccacccccuguaccaggaguaccggcuguggcaguucauccagaauuugaggaucuacugccgggaggcccgcauugacggcaaccucaugaucgacugggaggugaccaacgagcuguugcagacggaggaggacaagaccgcgcuguucgacuggcugaacgacaaggaguccgucaagcagcccgagcucguggccuuccugcucgggggcaaggccaacaagaagcagaucaaggcguaccgcuggaacuacauggacgacgacaccaagggcuacccgugcaacgagacgcgggccagccugcucaaguaccugcgcgaggcgcagacggacagcuccuuccugacccgggagcgcgaggaggccuuauggcacauccuguacagcaucuccgacaagggggagcucaagucugcacugggcaaguucgccgugaagcaugggcugaacgaacgguucgucaccguguucuccaaguucccgcccuucaagaaggacuacggcagcuacuccgccaaggcacugaagaagcuccugccccugaugcgcauggggcaccacuggcaggaggccagcuucauccccuccacccggcagcgcauggagaaguucaucaacggcgaguacgacgacagcaucgacaagcggacguacgagaagcucgagucccugaccgaggucagccaguaccgcggccugccgggguggcuggccugcuacgugguguacgaccggcacuccgaaggccgcgacaucgagcgguggaccucgcccuccgacaucgacagcuaccuggcccaguucaagcagcacucgcugcacaaccccauagucgagcgcgugguacucgagacccugcggacgguccgcgacaucuggaagcaggucgaccacaucgacgagauccacauugagcuggggcggaacaugaaacucccggcggacaagcgcaggcagaugaccgagcaggccuggaagaaugagcagaccaaucugcgcaucaaggcccugcuccuggaguucgcccggccuggcuacgacaucgagaacgugcgccccuacagccccuaccagcaggaccagcugcgcaucuacgaggaggccgugcucggggcgaacgagugcccggacgacaucuccgccauccugaagaaguuuaacggccugaacccgcccaccagcgccgaggugcuccgguauaagugcuggcuggagcagaaguaccgaagccccuacaccggccguacuaucccccugucgaagcuguucaccagcgccuacgagaucgagcacaucauccccaagcagcgcuacuucgacgacuccuucagcaacaaggugaucugcgaguccgaggucaacaagaagaagggggccaugcugggcuacgaguucaucaagagcuaccacggggcguccaucacccugaaccggggcggcaccgccagcaucuucuccguugaagccuacgagaacuucgugaaggagcacuacgcccacaaccgcgggaagaugaagaagcuccugauggacgacguccccgacaguuucaucucccggcagcugaacgacagccgcuacaucuccaagcucaugaaguccauccugagcaaccuggugcgggaggagggcgagaaggaggcgaucagcaagaaccucaucgugugcaccgggggcaucaccgaccgccugaagaaggacugggggauacacgacgucuggaaugacaucaucuucccgcgguucaagcgccuggacgagauggacuccagccacaccuacaucacccucaacacacaucggcaucccauccccagcaugccccuggaguuccagcgcggcuucuccaagaagcggaucgaccaccgccaccacgccauggacgccaucgugaucgccugcgccacccggaacaucgugaacuaccuuaacaacgagagcgcgcgccacgaugccaagaccucccggauggaccuccagcgccugcugugcaccgccaaccgcaagcucaucgacaagccguggaagacguucacccaggacacgugcaagguacuggaggacaugaucgugagcuuccagcgaacccugcgcaucaucaacaagacgaagaacuacuacuugcgguucgaagacggcaagaagcgccggguguugcagaccaagggggauaacugggccauccgcaagccccugcacaaggagaccuucuacggcgagaucaaccuccggcgcaucgagacccugucccugaacaaggcccucgagcggauccccgacaucgucgagcgcgaccugcggaaaaagcugagcgaacuccugucucugggguacaacgccaagcgcaucaagggcuacuucgaggagcacaaggaggaguggagcgacgugaaccucuccaagauaaaggccuacuacuucacgaagcagaagaacaagcgguacuucgccgcucgcaccgagcuggacacuagcuucaacaaagacaagaucgagaacaagaucgccgacaccgcgauccagaagauccugcuccagcaccuggaggccuacgggaacgacguagagcaagccuucucccccgagggcaucgacacgaugaaccggaacauccgccagcugaacggcgggcggagccaccagccaaucuacaaggucaggguguacgaggaggccaccaaguucgcggugggccggcgcgggaacaaguccaccaaguucgucgaggccgccaagggcaccaaccucuucuucgccaucuacgagauuagccagguggacggcaacggcaacagacagacguccagaaccuucagcucuaucccccugaauguggccgucgagcgccugaagcagggccucccacccgugcccgaggacgaggaggggaacgcgcccaaguacgugcucagccccaacgaccuggucuaccuaccgaccgagaaggagcugaagcggcgcgagauagccaugccgaucgacaagucccggaucuacaagauggugagcugcaccggcaaggacugcuucuucauccccgccaacacggccgugcccaucgucgaccgcuacgaguacagcuccaugaacaagaucgggcgggcccugaccggcgagaugaucaaggagaucugccucccccugaagaucgaccgccuugggcagauuaucgagaucagcaccuucuga

SEQ ID NO: 8052 - RNA, 4506 nt, Artificial Sequence
  Cas9 variant
augaagaaaauccugggccucgaccuggggaccaacagcaucggcugggccgugaucaacaaggccgagaacgaggggaaggacguccugugcggcaucgaggcggccgggucccgcaucaucccuauggacgccaccaucaugggcgauuucgagaagggcaacagcgugucccagacgaaggaccggcgcgagcaccggagcacccgccggcucuacgagcgcgggaagcugcggcgcgagcggcugaaccgcgugcucuccgucaugggcuuccugccggaccacuacgugagccagcuggaccgguacgggaaguuccucuccaacaccgagcccaagcuggccugggugcgcaacgccgacugcaaguaccacuuccuguucauggacagcuucuccgagaugcuccaggaguucaagaccaacagcccccaguacaucuccgaggagagcaaaguccccuacgacuggacgcuuuacuaccugcggaagaaagcgcucacccacaaagugaccaaggaggagcuggccuggauccugcucaauuucaaccagaagcgcggcuacuuccagcugcgggacgaguccgaggaggagaagaagccgagcaaaauccgccaguacuucgagcaccagaagguggucgacaucauagacaccaacgagguguacaaggggcugaaggugcucaucgucauccuggcgaacggcaucuccggcaagaucuucaagaaagagauccccgacuggaucgggguggagaaggacaucaucgugaaggucgacaucgacaaggacggcaaggacaaguucaacgaggacgggagccuguccugccgguucaacauccccacggaggccgagugggacaccgagugggaguugaucaagcagaagacccagaacgaucuggacgcgagcggcaagacaguuggcgaguacaucuucgacacgcugcuccgcaaccccgagcagaagauccgcggaaagcuggugcgcaccaucgagcgacgcuacuacaaggaggagaucaacgccauccugaagaagcagaaggaguuccacccggagcucuccgaccgcgcgcuguacgagaagugcgucgaggagcuguacccgaauaaccccgcgcaccggaacaugaugcucauccacgaccugagcuacuuccuggugaacgacauccucuucuaccagcgccccuuaaagagcaagaagucccugaucgacgagugcccguacgagagccaccucuacaucgacaagaagucgggcgagcggaaacccguggccgugaagugcaucgccaagagccacccccuguaccaggaguuccgccuguggcaguucaucuccaaccuccggaucuaucagaagaccaaggagguggggaacagccucaagguggacgucgacgugaccaacgaguuccuaaagggcgagaaugacuacgucgaacuguucgacuggcugaacacgaagaaggagaucaagcaggaggacuuccugaaguacaagcccuucggguucaccaagggcaacaucaacaacuaccgcuggaacuacguggaggacaagauuuacccgugcaacaagacccacuacaccaucuuaaagggccuggagaaggcggacaucacguucgacgaguucaucucccacgacagccuggccgaggagaaccuuuggcacauccucuacuccgugagcuccaaggaggagcugaagcacgcccuggagagcuucgccgacaagcggggacucuccaucaaguucgucgacgcguucaucaacacccccgccuucgagaaguccuacggcgccuacagcgccaaggccaucaagaagcugcuaccccucaugcgcauggggaaguacuggaaggaagagaacaucugcgacagcacccgggagcgcaucgacaagauaaucaccggcgaguacgacgagaacauccgggaccgcgugcgggagaaguccaucaaccugacggacaucacccuguuccgcgggcucccccuuuggcuggcgugcuacguggucuacgaccggcacagcgaggccggcaacaccgagcgcuggaccuccccgagcgacaucgaucacuacauccggaaguuuaagcagcacagccuccgcaaccccaucguggagcagaucgugcuggagacgcugcggacuguccgcgacguguggaccgaggugggcgggaucgacgagauccacguggagcucggucgcgagaugaagaaccccuccgacaagcggcgcaagaugagccugcagaugcaggaaaacgagaacaccaaccugcggaucaaggcacuccuggccgaguucaucaacccagagcuggggaucgagaaugugcgcccguacucccccagccagcaggaccuccugcggcuguacgaggagggcgccuggaacucacccgagaucgacgagaagcaggucgacgagaugcucgcgauccugaagaaguucaacgagacggacagcuccaagcgccccaccaagagcgagaucaagcgguaccggcuguggcucgagcagaaguaccgguccccguauaccgggaccccgaucccccugagcaagcuguucaccaccgccuacgaaaucgagcacgugaucccgcgcucccguuucuucgacgacagccucaccaacaaggugaucugcgaguccgaggugaacaagcugaagggcaacaugcugggauacgaguucaucaagagccacuacggggagaagguccagcucuccagcggcuccgaggugcagaucuucagcgugaacgacuacgagaaguucgucaaagaccacuacagcaagaacaaagccaagaugaagaagcugcugauggacgacauccccgagaaguucaccgagcgccagaugaacgacucccgguacaucagccgccucaucgugucccugcugagcaacaucguucgggagaagggggagcaggaguccaucagcaagaacguacucguguguaccggcggcgugacggaccgccugaagaacgacuggggcgucaacgacguguggaacaagaucauccugccccgguucaagaggaugaacgagaucaccgacuccaccgacuacaccagcgugaacacguccgggcacauuauccccgccaugccgcuccaccuccagaagggguucaacaagaagcggauagaccaccgccaccacgcgauggacgccaucgucaucgccugcgccggccggaacaucgugaacuaccugaauaaccagagcuccaagagcgacgugucccgccacgaccugcgcaaccugcugugcgagaaggacaagagcgaccggaaggagcucaucaucaagcccugggacaccuucacccaggacgucuacuccgugcugagcuccaucaucgugagcaucaagcagaacuugcgcgucaucaacaagaccaagaacaucuaccagcggaaggaggacgguaaggugaucaucuccaagcaggagaacaacaucaacuggugggccauccgcaagccccuccauaaggagacggugagcggcgaggucaaccugcggaaggagaccaccaucagccugaaggaggcgaucgacaaccccgcccgcaucaucgacaaggacuucaaaaagaagcuccgggagcugauccugaugggcuacaacgagaagcugaucaagaaauauuucuacgacaacaacgaauccuggcaggacgugaaccugaagaaaaucccggccuacuacuucacaaaggacacgaacgaccgguacuucgccagccggucccugcucgacgagaacuucgacaagaagaagaucgagaacaaggugaccgacaccgggauccgcaccauccugcuucggcaccucgaggucgaaggcggggacagcaagguugccuucucccccgagggccuggagcgcaugaacaagaacaucgagauccugaacgggggcaagaagcacaagcccaucuauaaggugcgggaguacgagaaggcggagaaguucgccgucggcaugcgcgggaacaaggccagcaaguucguggaggccgccaaaggcacgaaccucuucuucgcgguguacgacaacgggaagaagcgguccuucgccaccgucccccugaacgaggugauccgccugcagaaggagggccucccgagcgcccccgccaacgaggaggggcuguugcccaaguucgugcucucccccaacgaccuggucuacgugccgaccgaggacgagcugcggagcggccuccugcccgagaaccccgcgcccgagcgcaucuacaagauggucuccugcaccggcuaccagugcuucuucauccacuucagcguguccgggguccugugcgacaagaaggaguucagcucccucaacaagauggagcgggccaucagcggcgagaugaucaaggagaucugcaucccgcugaaggucaaccgcuuggggaagauaauguacaaccucuga

SEQ ID NO: 8053 - RNA, 4506 nt, Artificial Sequence
  Cas9 variant
augaagaccauccugggccucgaccucgggaccaacagcaucggcugggcgaagaucaguauugacgacaacgggaacuaccugcgcgacauccaguuaggcagccggaucauccccaugucccaggacgugcuggggaaauucgacaacggcgucacggagagccaaaccgccgugcgcacaggcuuucgggggcugcgccggauccgcgagcggagucuccuccgccgggagcgccuucaccgggugcuccaugucaugggcuuccugccgccccacuacgacagcgcgaucggguggaacaaggaggagccguccaccuacggaaaguuccucaaccacggggagcccaagcucgccugggagcgccagggcgacggcagcaugcgguucuuauucauggauuccuuccacaagaugauggaggacuucgccccucaccagcccgcccugguggccgacggucgcaagaucccccucgacuggacccuguacuaccugcggaagaaggcgcucacacagcccaucaagaaagaggagcuagccuggauccuacucaauuucaaccagaagcgcggcuacuaccaacugagaggagaggaggaggaggagaauccgaccaagcgggaggaguaccacgagcugaagguggucagcguggaggccgcggaggagggcaagggcgguaacaccugguacaacgugaagcucgagaacggcuggaucuaccaccggcccuccaagaucgaccugucugacugggucgggaagacgaagcaguucauagugaccauggaguacgaggcggacggcauaacgcugaagaagaacaaggagggcgaggugaagcggucguuuaggguccccgacgaggacgacuggggccuccgcaagaaacgcaccgagagccagcuggaggccuccggcaagacggugggggccuucaucuacgaccaucuccuggcugagcccgccgacaagauccggggcaauuucauucgcaccaucgagcggaaguacuacaagcaggaacuggccgauauccugcgcgagcagagcaaauaccacgaggagcuccaguccaagaaaauccuggccgacugcgccgaggagcuguaccggagcaaccaaccgcauagggacagucuccuaaagaaggacaugguguaucugcuccugaccgaccucaucuucuaccagcggccccucaagagcaaaaagucccugaucgcgaacugccccuacgaguacuacgaguacgucgauaaggagaccggcgagauuaagcgccaggguaucaagugcguggccaagagcaaccccuacuaccaggaguuucggcuguggcaguucgugcucaaccuacgcuuauacgaccgaaccgaggacaaagagguaaccgcggaauaccucccgagcaaggaggacuacgcccgccuguucguguaucugaacgaccggaaagagaucaaccaggaaacccuucucaaggacuucuucaagcugaaaaaggucaagcagcgcuccgaaaaggaguuucccguccgguggaacuacaucgaggacaaagagaagaaguaccccugcaacgaaacccgccacgagcugcucauggcccuagaccgggccgggauggagcgcagcuggcuggaugacacugcgcggcaguaccgccucuggcaccucuuguacuccaucgaggugaaggacgaggcggaacgcgcccugcggaagcugaaggacgacgacgaguucgugucagccuuccugaagguaaaacccuucaagaaggacuacggcgcguacuccgagaaggcagugaagaaauugcuugcggucaugcgcaugggcagccacuggugcgaggacgacaucugcaaggagaccaaggagcggaucgagcacauccugcagggggacguggaggagaagauuaaggagcgcaugaaccacaccgccuacucccucggcgagcugagcgacuuucaggggcuuccggaauggcucgccugcuacguggucuacggccggcauuccgaagccaccgacauaaaacauuggaagacgcccgaaagccugauggcguacaucaacgguuucaagcagcacuccuuacgcaacccaaucguggagcagugcauccucgaaacccugagaaccgugcacgacauuuggaaggaggccggccacaucgaugagauccacgucgagcugggccgcagcaugaagucaaccagcgaccagcgggcacgcaugacagaaaacauccuucgcaaugagaacaccaaccugcgcaucaaaucccugcucauggagcuuaagaaugacgccgacauaaaggacgugcggcccuacagcccgaugcagcaggagauccugcgcaucuacgaggagggggcucuccaggagcuaacgaaggaagacaacgacuaugaggagaucuucaaaaucuccaagaucccccaacccagcgcgaaggaacuguugaaguacaagcuauggcuggagcagaaguaccggagccccuacaccgguaagccaaucucccucagcaagcuguucacgucagccuaucaaaucgagcacaucaucccccagagucguuacuucgacgacuccuucaacaacaaggugaucugcgaaagcgaggucaacgcccugaaguccaacauguuaggguacgaguuuaucaagaaccacggaggcgagaucgugcacugcacccuguuaggggacgucaagguacagaacgagagcgaguacaaggccuucgugaccgagcacuacgccaacaacaaguauaagaaggagaagcugcuuauggaggacaucccccaggacuuccuaaaccggcaucucaacgacucccgcuacaucagcaagguggucaagacccuacuguccaacaucgugcggacggaggacgagauggagaccaccagcaaguucguggucuccugcaccggcgggaucaccgacagacucaagaaggacuggggacugaacgacgucuggaacagcauaguguacucccgguucgaacgcuugaacgaguugaccaagagcgacgcguuuggccgcugggagaauaaagagggcaagaggguguuccaaacguccgucccgcuggagcugcagcgcggcuucaacaagaagcggaucgaccaccgccaccacgccauggacgcccucgugaucgccugcgccagccggaacauuaucaacuaccuaaacaacgagucagcgaacucccccaagaagcgcgaggaccugcggcagcaacucugcgacaagaaccgcaucauccggaagcccugggagagcuucacccaagacgcucgcgccgcccuggaggacgucgucguguccuucaagaacuacguccgcgugaucaacaagaccacgaacuacuacgaaagguacggggcggacggcgagaaaaccaucgccaagcagaagaacagcgagaugugggcggugcggaagcccaugcacgaggccaaguacuacggccgcgucaaucugcaacggaagacugaggugcgacugaaagcugcgcuggaagacauuccguccauauguaacaaggagcugcgggacuacaucaaccgccucgucaagagcggccugaacgcccggcagcugcucgcccacuucaaaucuaccgauuacugcuggaacaaacagaacguggacaagguggaggucuggagauucagcgacgaaaaggagccccuggucgccauccgcgaaucccucgacacgagcuucgacgccaagcggaucgacacuaucaccgacaccgggauccagaagauccuccuuaauuaccuggaagcgaagggcggcgaccccgccaucgccuucacgccugaggggaucgccgagaugaaccagaacauggcacucuacaacaacggcaagaugcaccagccgauucugcgcgugcggcuguccaagaagcgcgggaagaaguaccaagugggucagaccgggugcaaggccaagcaguucgucaucagcgaaucuggcaccaaccucuacuucgccauuuaugaggaugaggaccggaaccgcacguacaacacaaucccccugaacgagguggccgaacggcugaagcagggccucagccccguccccgagaagaacgagaaggaggucccgcugaaguucuaccugucccccaacgacuugguguacguacccaccgaagaggagauccugaugaaggagugcaagcugaacaagaaccguauuuacaaauucaucgacagcagcgggaccaccgccaacuucgucccacacagaagcgcgucccucaucuacaacguagacaagaagcuggccgaggccuucugcaacgacgagaucauccagaacgaauacgguguggggagcccacagucgaagaaccagaaggcccugacgggcgagaugauuaaagcagucugcuggaaauuggagguggaccgccuggggaacaucauacggguaauuaaguga

SEQ ID NO: 8054 - RNA, 4515 nt, Artificial Sequence
  Cas9 variant
augaagaacaucgugggccuggacuuggggaccaauagcaucggcugggccgucgugaacggaaacaucaaugacgacggcuccgagcagcuggugaaaauccaggcuagcgggucccguauuauacccauggacgcggccaugaucggcgacuucaacaagggcaacucgaucucccagaccgccgagcggacgaggcugcgggggauccgccggcucagcgagcgcuaccugcugcggcgcgagcggcuucaccgcauucuggacauccuggguuuccucccgucccacuucgcccgugaccuggaccguuacggcaaaaucguaaaggacaaggagcccaagcuggccuggcggaaaaacgaggcgggccaguucgaguucaucuuccaaaacagcuucaaagaaaugcucgaggacuucaagcugaaccaccccaaccugaucacugacgacaaaaaggugcccuacgacuggaccauuuacuaccuccgcaagaaagggcugaccuccaagaucaguaaggaggagcuggccuggauacuccugaacuucaaccagaagcguggcuacuaccagcugcgcggcgaggaggaggaggagaacaagaacaagcaggucgaguucuacgcccuaaaggucaucgccguggaggacuccggggagaagaagggcaaggacacgugguacaacgugcaccuggagaacggguggaucuaccggcggacgagcaacaugccgcucgacugggucggcaagaccaaggaguucaucgugaccacggaccucgagaaggacgguacccccaagaaggacaaggaggggaacaucaaacgguccuuccgggcgcccaaggaggacgacuggagccuggugaagaagaaaaccgaggccgacaucgaccaaacucacaagacggucggcaccuauaucuacgacaccuuacucgggaaccccucccagaagauccggggcagacuggugcgcaccaucgagagaaaguacuacaaggaggagcugaagcucauccuggauaagcagaaggaguuccacccggaguuacaggaccgcgcccucuacgcagccugcguggaggagcuguacaccaucaacgaggcgcaccggaacaacauagggaaccgcgacuucacauaccuguuccuugaggacaucuuauucuaccagaggccccucaagagcaagaagucccugaucgacaacugccccuacgaggagaaccacugccuggauaaagagaccggugagaucaaguucuucccugucaagugcaucgcgaagucccacccccucuuccaggaguuccgccucuggcaguucaucguuaaccugcggaucuacaggaaaggccuggcccaggacguggacgucaccaacgagcuccugaagacggaggaggacuacgucgcccuguucgacuggcucaacggaaagaaggagaucgaccaaaaggccuuccugaaguacccgccguucggccugaagaaggagguggagaacuaccgguggaacuacguccaagacaaguccuaccccugcaacgagacucgcagccugaugcucgcgcgauuagagaagugcgacaucagcaucgaguuccugaccaaggaaaacgaggaggcgcucuggcacauccuauauuccguugaggacaagaacgaaaucgugaaagcccugcagaaguucgccgacaagcacaaccucaacgccagcuucgucgacguguuccagaaguuccccagcuuuaagaaggaguacggauccuacuccgcgaaggccaucaagaagcuccugccccucaugcgcaugggcaaguacuggagcgaggacuccaucgacaaagggacccgggagcgcauggauaagaucaucacgggcgaguacgacgagaagaucgagaaccggguccgcgagaaggccauccaccuggcggacaucagcgaguucaaggggcugccccucuggcuggugugcuacaucguguacgggcggcacucugagagcaaggagauagccaagugggagucccccgcggacaucgacagcuaccugaaguccuucaaacagcacagucuccgcaacccgaucgucgagcagaucaucaucgagacccugcggguggugcgcgacaucuggaagcaggucggcaacaucgacgagauccacguggagcuggggcgcgagaugaagaacccggccgacaagcgucgcaaaaugacccagcagaucuccgagaacgagaacaccaaccuccggaucaaguaucugcugacggaguuccucaaccccgaguacgagguggagaacgucaggcccuacagcccgucccagcaggacauccugcgcauuuacgaggagggggugcugaacagcguuuccaaccuccccgaagagauaagcgacauccugaagaaguucaccgagaccgaccugaagaagcgccccagucggucugagguccuccgcuacaagcuguggcuggagcagaaguaccggagccccuacaccggggaggugaucccgcucggcaagcuguucacgcccgccuacgagaucgagcacgugaucccccagucccgcuacuucgacgacagcuucuccaacaaggugaucugcgaggcugaggugaauaagcucaagagcaaccugcugggccacgaguucaucgugaagcaccacggggagaucgucgagcugccguucggcaagaagguaaagaucuucaccguggacgaguacgagcaguucgucaaggacaacuacucccggacucgagggaagaugaaaaagcuccugguggacgacauccccgaggaguucguggcgcggcagcugaacgacucaagguacaucuccaaggucgucaagagccuccuguccaacaucgugcgggagaaaggcgaggaggaggccaucucgaagaacgugauccccugcaccggcggggugacggaccgccugaagaaggacuggggugugaacgacguguggaacaagaucauacucccccgguuccagcgccugaacgaacugaccgggaccaacaaguucaccaccaugucccucaacaaccacgagauccccgcgaugccccuggagcugcagaagggcuucaauaagaagcggaucgaccaccgccaccaugccauggacgccaucaucaucgcgugcgcuaaccggaacaucaucaacuaccucaacaacgagagcgccacggccaaggcugagcugucccgcuaugaccugcagcgccuccuaugcgacaaggccaagaccgacgacaacgggaacuacaagugggugauccggaagcccugggccagcuuuacccaggaugugcacggcguccuggaggauauaaucguguccuucaagcagaaccuccgugugaucaacaaggccacaaaccauuucuuacacuacaacgaagagggcaagaagaucuucgucaagcaagaaaagggggacagcugggccauccgcaaguccaugcacaaggacacgguguuuggcgaagugaaccugcggcggaucaagaccgucgcgcucaaugaagcgaugaagaacccccaguccaucguggugaaggacuucaagcgcaagcugcuggagcuccugaaccugggguucgacgccaagcggaucaaaaaguacuucgaggacaaccgcgaaaccuggagcgacaucaaccucuccaagaucaccgucuacuauuucagcaaggauacgaaggaucgguucuucgccacccgcaagccgcuggacaccuccuucgaccggaagaaaaucgagaacaacaucaccgacacgggcauccagaagauucugcuccgccaccuggagcugaaggacaacaaccccgacaucgccuucagccccgacgggaucgaugagaugaaccggaacaucauccagcucaacaacggcaaguaucaccagcccaucaucaaggugcgcugguacgagcaggcggacaaguucgccgugggccagaccgggaacaaguccagcaaguuugucgaggccgccaagggcacaaaccuguucuucgccguguacgaguccaacauccuggacgagaagaccaacacgaucaucaaaaagcggaacuacgcgaccaucccgcucaacguggccaucgagcgccagaagcaggggcugagcgucgcccccgaggaggagaacgggaacgaucccauauucgugcugucccccaacgaccuaguguaccugccgaccaccgacgagcuggccaacggggucguggcccagccccucgacaaggagcgcaucuacaagauggucagcugcacuggcaacgagggacacuucauacccgcgcguaucgccaaccccauccugcagaccaucgagcugggguccaacaauaaggcccagaaggccuggaccgacgagaugaucaaagagaucugcaugccgauuaaggucgaccggcucggcaacauccuggagagcuccagccugcacaagaaguga

SEQ ID NO: 8055 - RNA, 4515 nt, Artificial Sequence; identical to SEQ ID NO: 2255
  Cas9 variant

SEQ ID NO: 8056 - RNA, 4515 nt, Artificial Sequence
  Cas9 variant
augaagaacauagugggccucgaccuugggaccaacagcaucggcugggccgucgugaacggguccgugaacgacgacggcagcgagcagcuggucaagauacaggccuccgggagccgcaucauccccauggacgcggccaugauuggcgacuucaacaagggcaacuccaucagccagaccgccgagcggacgcgccugcgcggggugcggcggcucuccgagcgcuaccugcugcggcgcgagcggcuccaccgcauccuggacauccugggcuuccucccguuccacuuugcccaggaccuggaccggcacgggaagaucgugaagggcaaggagcccaagcuggccuggcgcaagaacgaggcggggcaguucgaguucaucuuucaggacagcuucaaggagaugcucgaggacuucaagcugaaccaccccaaccugaucaccgacgacaagaagguccccuacgacuggaccaucuacuaccuccggaagaagggccugaccuccaagaucagcaaggaggagcuggccuggauccuccugaacuucaaccagaagcgcggcuacuaccagcugcguggggaggaggaggaggagaacaagaacaagcucguggaguucuacgcccugaagguggucgccguagaggacuccggcgagaagaaggggaaggacaucugguauaacgugcaccuggagaacggcugggucuaccggcggacgagcaacaugccgcucgacugggugggcaagaccaaggaguucaucgugaccaccgacuuggagaaggacgggacgcccaagaaggacaaggagggcaacgucaagcgcuccuuccgggcgcccaaggaggacgauuggagccucgugaagaagaagaccgaggccgacaucgaccagacccacaagaccgugggggccuacaucuacgauacgcuccugggcaaucccucccagaagauccgcgggcggcugguccgcaccaucgagcgcaaguacuacaaggaggagcucaagcagauccuggagaagcagaaagaguuccaccuggaacuccaggaccgcgcccuguaugccgcgugcaucgaggagcuguacccgaucaacgaggcccaccgcaacaacgugggcaaccgggacuucacauaccucuuucuggaggacauccuguucuaccagcgcccccucaagagcaaaaagucccugaucgacaacugccccuacgaggagaaccagggccuggacaaggagaccggcgagaucaagagcuuccccgugaaaugcaucgccaagucccacccacucuuccaggaguuccgucuguggcaguucaucaucaaccugcgcaucuaccggaaggaccucgcccaggacgucgacgugacgaacgagcugcugaagaccgaggaggacuacguggcccucuucgacuggcugaacggcaagaaggagaucgaccagaaggcguuucugaaguacccggucuuccgccugaagaaggagaucgagaacuaccgguggaacuacgugcaggacaagccauaccccuguaacgaaacccgcagccucaugcuagcccggcuggagaagugcgacaucagcaucgaguuccucaccaaggaaaacgaggaggcccuguggcacauccuguacuccgucgaggacaagaacgaaaucgugaaggcccuccagaaguuugccgacaagcacgaccugaacgcgagcuucguggacgucuuccagaaguucccgcccuucaagaaggaguacggguccuacagcgccaaggccaucaagaagcugcucccccugaugcgcaugggcaaguacugguccgagaacagcaucgacaaagggacgcgggcccgcaucgacaagaucaucaccggcgaguacgacgaaaagaucgagaaccgggugcgggagaaggccauccaccuggcggacguguccgacuucaagggccucccccuguggcuggucugcuacaucguguacgggcggcacagcgaggccaaggagaucauccaguggaaguccccggccgacaucgacagcuaccucaggaguuucaagcagcacagccugcggaaccccaucguggagcagaucaucaucgagacccugcgcgucgugcgcgacaucuggaagcaggucggcaacaucgacgagauccacguggagcucgggcgggagaugaaaaaucccgccgacaagaggaagaagaugacccagcagaugucggagaacgagaacacgaaccugcggaucaaguaccugcucaccgaguuccugaaccccgaguacgagguggagaacgugcgaccguacagccccucccagcaggacauccugcggaucuacgaggagggcguccucaacagcguguccgaccugccugaggagaucagcgacauccugaagaaguucaccgagaccgaccucaagaagcgccccucccggagcgagauccugcgcuacaagcuguggcucgagcagaaguaccgcagcccguacacgggggaggucaucccccugggaaagcuguucacccccgcguacgagaucgagcacguaaucccgcaguccugcuacuucgacgacagcuucuccaacaaggugaucugcgaggccgaggugaacaagcucaagagcaaccugcugggccacgaguucaucgucaagcaccacggggagaucguggagcucccauucggcaagaaggugcgcaucuucaccgucgaugaguacgagcaguucgugaaggacaacuacucccggacccgcagcaagaugaagaagcugcugauggacgacaucccugaggaguucgugacgcggcagcucaacgacucccgcuacaucagcaaggucgugaagucccugcugagcaacaucgugcgggagaagggggaagaggaggccaucuccaagaacgucauccccugcaccggcggcgugaccgaccgccucaagaaggacuggggaaucaacgagguauggaacaagaucauccugccgcgguuccagcgccugaacgagcucacuggcacgaacaaguucaccaccaagaacgucgggcugcaggagauccccaccaugccccuggaguugcagaagggcuucaacaagaagcggaucgaccaccgccaccacgccauggacgccaucauaaucgcgugcgccaaccggaacaucaucaacuaccugaacaacgagagcgccacugccaaggccgagcugucccgcuacgaccuccagaagaugcugugcgacaaggcgaagacggacaacaacgggaacuacaagugggugaucaggaagcccugggccagcuucacccaagacaccuaccuggcccucgagaacaucaucguguccuucaagcagaaccugcgggucaucaacaaggccaccaaccgcuuccuucacuauaacgaggagggaaagaagaucuucgugaagcagggcaagggggacaauugggccauccgcaagagcaugcacaaggacacgguguucggcgaggucaacuuacggcggaucaagaccguggcgcugaacgaggccaugaagaacccgcaguccaucguggucaaggacuucaagcgcaagcugcucgaacuguggaaccucggguucgacgccaagaggaucaagaaguacuucgaggacaaccgcgaaaccuggagcgacaucaaccucagcaagaucgagguguacuacuucuccaaggacaccaaggaccgguucuucgcuacgcgcaagccccuggacaccagcuucgaccggaagaagaucgagaacaacaucaccgacaccggcauccagaagauccugcuccgccaccuggagcugaaggacaacaaccccgacaucgcuuucucccccgacgggaucgacgaaaugaacagaaacaucauccagcucaacaacggcaaguaccaccagccgaucaucaaggugcgcugguacgagcaggccgacaaguuugccgucggccagacggggaacaaguucagcaaguucguggaggccgccaagggcaccaaccuguucuucgcgguguacgaguccaacauacuggacaagaagacgaacaccaucaucaagaagcggaacuacgccacgauaccccucaaugucgccaucgagcgccagaagcaggggcugcccguggcccccgaggacgagaacggcaacgacccgaucuucgugcugagccccaacgaccucgucuaccugccaaccgacgacgagcuggccaacgguaucaucgcgcagccccucgaccggggccgcaucuacaagaugguguccagcuccggcgagcagugcuucuucauaaagcacaucgucgccaacgugcugguggacaaguucgaguucagcccgcugaacaagauggagcgggcccucaccggggagaugaucaaaaugaucugcauccccaucaaggucgaccgccugggcaacgugcuggaguccagcuccagccacaagaaguga

SEQ ID NO: 8057 - RNA, 4515 nt, Artificial Sequence
  Cas9 variant
augaagcgcauccucggauuagaccuggggaccaacagcaucggcugggcccugaucgagaacgacuucaacagaaaggaggggaagaucgaggcccucggcucccgcaucauccccaugucgcaggacauccugggcaaguucgacuccggcgugaccgucagccagacggcggcccggaccaacuaucgcgguaucagacgccuguaccagcgggacaaucuccgccgggaacgccugcaccgggugcugaacauccucggguuccugccgaagcacuacgccgaguccaucgacuucgaagaccgucugggccaguucaagcccgagacggaggugaagcuccccuaccggaaggacucugacgauaacuaccacuucaucuuccaagaguccuucaacgagauggucgaagaguuccaguucaagaaccccagccuuuucuacaccaaggccaacggggaacaguccaagaucccguacgacuggacgcuguacuaccuccgcaagaaggcccugucaaagaaaaucuccaaggaggagcuggcguggauccuucugaacuucaaccagaagcggggcuauuaccagcugcgcggugaggaggaggcagacagcaaggauaagcucgaggaguaccacgcccuuaaggugagugaugugcaagccaccgaggauaccaacgccaagggcaccugguacaacgucauccuggagaauggcuggaucuaccggcgccagaguaaggacucccucuucgauuggaaggggaagacgcgggaguucaucgugaccaccagccuagagaagggcggcgccgugaagaucgacaaggagggcaacgagaagcgcuccuuccgggccguggauagcgagaaagacuggaucgccaucaaaaagaagaccgagaacgaccuggccaacgcgggcacgaccguugggguguacauauacgagacgcuccugcgcaacccugaccagaagauccgcggcaagcucaucaaaaccaucgagcggaaguacuacuuggaggagcugaaggccauccuggccaaacagauccaggaacacgcggagcuccagaaccgaucccuguacaaggacugcaucgaggagcuguaccaggggaaugaggcccauaagaacaacaucaaggagaacgguuucgacuaccucuucuuagaggacaucaucuucuaucagcggccccucaagagcaagaaguccacgaucagcaacugcccuuacgagagcagggucuucaucaaggacgggaaaaaggagauccagccgaucaagugcaucuccaagagcaacccaaucuaccaggaguuccggcuguggcaguucauccacaaccugaagaucuacgagaaggaggcgaucgacgacgguaagaccgugaucaacaaggacgugaccaccgaguuccugaacacgcaggaggccuacgccgcccucuucgaguuccugaacgacaaggccgagaucucccagaacgcgcugcucaaguacuucaagcugucgaccaacacccaccgcuggaauaacgucgaggacaagaaguaccccugcaacgagacccggucagaguucaucaaacgccugagcaagauggacggaaucgaccucgggaagacgcugucccccgcuuucgagaagucacuguggcacauuaucuacagcgugaaggacaagaagcaguacgugcgggcgcuggagaccuucgccaugaaaaacggccucgacaucaaccaguuucgugagaacuucgagaaguuuaagccguacgacagcgccuacggggcguacuccgagaaggcccugaagaaggugcugccccucauccggcgcggcaccuauuggaagaaggacgccauccccgccgcggugcaggagcggaucgugaacaucaugaagcgcauagaaagcgucgacuucaaccuggagaagaucgagaacuucgccgacgaugacauccccaagcagcugcuuaaguccuucgccaaggggaaggacccgaugcagggccugaacaccuaccaggccugcuacgcgguguacaaccggcacagcgaaguaagcgacauccaacuguggaaguccccagaggacaucacgaaguaccucgacagcuucaagcagcacagcuuacgcaaccccaucgucgaacaggucgugauggagacccugcggguggugcgcgacaucuggcaguacuacggcaacggggcgaaggacuucuucagcgagauccaugucgagcucggccgggagaugaagaacgacaaaaagacccgcgagcgcaucuccaagagcaucaccgagaacgagaacacgaacgagcggaucaagaacauccugaaagagcugaugggggacgaggcccuccagggcgacauccgcccauacucaaaggggcaccaggacauccugaagcuguacgaggagggcguuuucgccaacgccccggagaccuacaaaaacaucaagaucgacgacaucgagaagauccggaagaacaauagccccuccaagagcgacaucgucaaguacaagcucuggcuggagcagggcuacaucucccccuacaccgggagccccaucccguuaucccgccucuucaccacggacuaccagaucgagcacaucaucccccggagccgcuacuucgacgacuccaugggcaacaagaucaucugcgagagcgccgucaacgaggagaagaccaacaagaccgcguacgaguucaucaaggagaacgcggggcggaucaucgaccugggccagggcaagcaggucccacuguuugaccucgaagccuacgagucccacugccgcgguuacuucaagggcaacaccaagaagcugaaguuccugcucagcgaggacauccccgagggcuucaucaaccggcagcugaacgacucccgcuacaucagcaagguggugaccucccugcucagcaacguggugcgggaagagggugagcaggaggccacgagcaagaaccuggucccgcugguggggaccaucaccuccaagcucaagaaggacuggggccuggaggccauaugggacgaccugaucgcgccccgcuucgagcggaugaaccagcucaccaagagcacggauuuccgcaaggaggugaucgacggccacgggaaccgguacuuuaucaacaccguccccgacgacaucaagaagggcuucuccaagaagcgcaucgaccaccggcaccacgcccuggacgcccuggugaucgccugcaccaccaaggaccacgugaacuacaucaccagcuuaaacacccagcggaacaaccggucccuggucagcaagcugcgcaagaucgaagagaaaaccaucaaggacaagcggaccgggcagccgaaaacgaucaagaucgcgaaggccuaccacaagccauggccaaacuucaccaaggagaccuucgagaagcucuccaaaaccguggugagcuucaagcagaaccagcgcaucaucaacaagacgaacaacaaaaccuggggcugggagaaggucgacggggugaugaagaaggugcuaaagaagcaggagaagaggaacugggccauccggaagcccauccacaaggaaaccuacuacggcaagguaaagggcuucgacuccccgaaggguaagaucaccacggccacgcgcaagagccugagggagaucaccaacgagcgccagcucaacaccaucacggacuccggcaucaagaagauccuaaacaaccaccugaagaccuucaucgacgagagcgggaagaucaacuucgagcccgccuucaaccaggacggcaucgaccuccugaacaagaacauccagcagcugaacgaggggaagaaccaccagcccaucuauaaggugaggauguacacccacaacaccauguucuccgugggcgacgagggcaacaagagcacgaaguacgugauccccgaguccggcaccaaccucuucuucaacguauacugggacgaggagaacaacaagcgcaacuucgagaccgugccgcugaaccgggucaucgcguuccagaagcagaccagccacauccccaggaaggaccggacggacgugcccaucgacaauacccugggccgcuuccucuucacccugucccccgacgaccugguguaccucccgaccgacgaggaguccgaguccuuuacuaccuucgagaucgacagccugaacagcaagcaggucgccaauaucuacaaauucguggauggguccggcaccaccgggaacuucgugcccgccgaggccgcccgggucaucgcgaacaucaaggauaagaaggugaggagcaacuucugcaagcggaacaaucuguccgacaagcagcucaucaaaaacgaguucggccugggcagcccccagcugaagaaccagaacucccucgacgggcgccagaucaagagcaucugcuggaaguuagagaucaaccggcuggggaaaaucaucaaggucaucaaguga

SEQ ID NO: 8058 - RNA, 4515 nt, Artificial Sequence
  Cas9 variant
augaagaaggugcugggccucgacauugggacaaacagcgucggaugggccguggugaaccagaacgacaagggggaguuccugucgaucgagaagaucggcagcaggaucauccccaugucccaagacgucauggacaaauucggggccggccagaccgagagcuccacggcgcagcggacccaguaccgcggcgugcggcgccuucgggagcgcucucucuugcggcgcgaacggcugcaccgcgugcuccacauccugcacuuccugccgcagcacuacgaugccgcgaucggguggaacaaaaaggagaacaagaccuacggcaaauuccuccccggggucgagguaaacauucccuggguggccaccgaccagggucaccaguucaucuucauggacuccuaugccgagaugcugaaggaccugaagcagcaccagccccaccucuucgagaaguccagcacgccuguccccuuggacuggaccaucuacuaccuucggaagaaggcgcucacccaggccaucagcaaggaggagcuggccuggauccugcuaaacuucaaccagaagcgcggguacuaccagcugcggggcgaggagguggaagacaacaccaagcgcgaggaguucuacgcccugaagguggucaagguagagcucgacaaggauaacacguccgcgaaaaccugguacaagguccaccuggaaaacggcuucaucuaccccugccccagugacaccccgauagacuccuggguugggauggugaaggauuucaucgugaccacgacccuggagaaggacgguagcgagaagcggacggccgacggggagaucaagcgcuccuuccgggccccuaaggaggacgauuggacccuccugaagaagaagacggagagcgagcuggagaaguccggcaaacaggucggcgccuucaucuacgacacccuccugaguaaccccgaucagaagaucaucgggggccugaucaagaccaucgagcgcaaguauuacaagaaggaacucgagcagauucuagagacccagcagaaguucaucgcugagcuguccgacaagaagcuguuccaagcgugcgccgaggagcuguacccccugaacgacagucaccgggaaaaccuccuggagcgcgacuucaagcaccuguucguucaggacaucaucuuuuaccaccggccgcucaagacgaagaagucccugauuucaaacugcaccuacgaguaccgcaccuucuacaagaacggggagaagcaaaucagccccaucaagugcaucgccaaguccaacccccuguuccaggaguuccgcgucuggcaguucguccagaaccuccgcauucugcagagacagaggagcgagggcgacaguaucaaguacaacguggaugugaccgccgaguuccugaaggacgagaacgacaucgccaaccucuucacguggcugaacgagaggaaagucaucaaacaggaccagcugcucaaaagcuacuucaagcugaaagucaacaaggagaccaaggagcuggacuaccgguggaacuacgucgacgacaagaacaaggaguaccccuguaacgcgacccgcacccacauccuguccuuccucgagaagugcaaggaggagaagcggaucgaggacgaccgcuucguguacagccuguggcaccuccucuacuccguugucgagccgaucgagcugagaggggcccuggcgaaguucgcggagcgcgagcaccuccacccgagcuucguggacguguucgcccaauucccgccccuggagaaggaguacggcuccuacagcgagaaggcgaucaagcggcugcugccccugaugcgcaugggggacuacuggcacgaagacaagaucgacgucaagacuaagcagcggauacagcgcauuaucgacggcgaggcggacgacgacauaacccaccggucccgcgagaagguggagaaccugagaagcaucaccgacuucaagggacucccccuguggaaggccggguacguggucuacaaccgccacuccgagagcggggagcugaccaaguggaagacgccccacgagcucucuaacuacauccagaacgaguucaagcaauacagcuugagaaaccccaucguggagcagaucguucuggagacccuccgcgucgugcaugaccugugggugaagcacggggacuucuccgagauccaccuggagcucggccgcgacaucaagaacagcagcgacaagcggaagcgcauggccgaacggcagcaggagaacgagaacucccgucagcgcguccuggagaugcugaucgaccucaagaaggaggccgcguucgccgaccugaacccguacagccccucccagcaggagaagcugcgcaucguggaggauggcgugcuacgguccaacaucgagauccccaaggacaucgagaagaucaccaaguccgccaagcccaccagccgagaacugacgaaauaccggcuguggcucgaccagaaguaccgcuccccguacacggggcagcccaucagccuggcccagcuguuuaccuccaaguacgagaucgagcacgucaucccccaggcgaaguacuucgacgacagcuucacgaacaaggugaucugcgaguccgaggugaacaaggagaagggcagcaugcucgcccacgaguucauccugaagaacgguggcucuaccgucaacgugggcgggcgccaggugcagguccugaagaacgaugccuacguggagcucaucaaccggcuguacggcaagaacaauccggugaaggccaagaagcugcucgccgaggacaucgacgagguuguuggggacuucagcgagagacagcuaaacgacacgcgcuacaucucccgggugguccagaagcugcucagcaacauugugcgcgaggaggacgagcaggaguccaccagcaagcacgugaucggcugcagcgggcaggucacaaccgcccugaagaaagacuggggccugaacgacaucuggaacaagaucauccagccccgguucgaacgccucaacgagaugacggccaccgaggacuacggcguuuggcagucacccaaccacuuccagauccgggugcccgaggagauccagaagggguucaccaagaagcgcaucgaccaccggcaccacgccauggacgcccuggucaucgcaugcgcgacacgcucacacaucaacuacaucuccaaccgcagcggccaggaccggaacgccaaguucgagacgacccgcaccgaccugcgguccaagcucugcuacaaggagaacagcuccgggaacaacuacaacuacauauucaacaagccgugggacaccuucacgcaagacgcccaccgcgcccuggaaaacaucguggugucacacaaacagaaccuucggguccucaccaagaccaacaacuacacccaauucauuaacaaggacggcaagaaggaccugcagaagcaggucaagggggaccacuucgccgugcgcaagcccaugcaccaggagacgaucuacggaagaguguccauccgcagcaucaaggagguggcgcugaaaaaggcccucgagaacuggaagcagaucguggaccggacgcugaaggacaagauccgcgagcugaucggcgccuacgggaaguacgacgcccaaacgauccucaaguacuucaaggaccgggacuacaaguucaacaaccugaagaucaaccgcgucgagguguaugaguacgaccauaacugcgcggccgugcggaaguccaucggcgaugaccugaccaucaagcagaucgagcgcaucacugacgagucuauccggaagauccucaugaaccaucugaguaacuacgacgacaaccugaaggaggccuucagccccgaggggcucauggagaugaacaagaacauuaaggagcugaacggcgggaagaaccaccagcccauuuacaagguccggcuguucgaggaccucggguccaaguucccgcugggggugagccacaacaaccccgacaaguacgccaucgccgcgaaggggaccaacuuguucuucggcaucuacgaggaccaggaggggaagcggauguucgacuccaucccccucaacaucgugaucgaccgccugaaggagaagaaguccccagucccggagaccuacaacgagagcaagcugaaguuucaucucucccccaacgaccuggucuacguccccaccgacgaggagcagaagcagccggagcugguggacguggaccaccucagcgacgaacagaaaggccgggucuacaaggccguguccuucacagggaaccgagcuuucuucgugaaccaccgcgucagcaaggugauccacgauuacguggaguucggcaccaagaacaagaucgagaacgacgacgacaagcgaucccugaagcauaucugcuggaaacugaaggucaaccgccucggcgagaucaccgacgugaagcgguga

SEQ ID NO: 8059 - RNA, 4515 nt, Artificial Sequence
  Cas9 variant
augaagaacaucgugggccuggaucucgggaccaacagcaucggcugggccgucgugaacggguccgugaacgacgacggcagcgagcagcuggucaagauccaagccuccgguagccgcaucauucccauggacgccgcaaugaucggcgacuucaacaaaggcaacuccaucagccagaccgccgagcggacgcgccugcgcggggugcggcggcucuccgagcgcuaccugcugcggcgcgagcggcuccaucgcauccuggacauccugggcuuccucccguuccacuucgcccaggaucuggaccggcacgggaagaucgugaagggcaaggaacccaagcuggccuggcgcaagaacgaggcggggcaguucgaguucaucuuccaggacagcuucaaggagaugcucgaggacuucaagcugaacuaccccaaccuaaucaccgacgacaagaagguccccuacgacuggacuaucuacuaccuccggaagaaaggccucaccuccaagaucagcaaggaggagcuggccuggauccuccugaacuucaaccagaaacguggcuacuaccagcugcgcggggaggaggaggaagagaacaaggacaaacucguggaguuuuacgcccugaagguggucgccguggaggacucgggcgagaagaaagggaaagacaucugguacaacgugcacuuagagaacggcugggucuaccggcggacgagcaacaugucccucgacuggguaggcaagaccaaggaguucaucgugaccaccgaccuggagaaggacgguacgccgaagaaggacaaggagggcaacgucaagcgcagcuuccgggcgcccaaggaggacgacuggucccuggugaagaagaagaccgaggccgacaucgaccagacccacaagaccgugggggccuacaucuacgacacgcuccugggcaaucccagccagaagauccgcgggcggcugguccgcaccaucgagcgcaaguacuacaaggaggagcucaagcugauccuggagaagcagaaggaguuccaccucgagcugcaggaccgggcccuguacgccgcgugcaucgaggagcucuaccccaucaacgaggcccaccgcaacaacgugggcaaccgggacuucacauaccuguuccuggaggacauccucuucuaccagcgcccgcugaagucuaagaaguccuuaauugacaacugccccuacgaggagaaccagggucucgacaaggagaccggggagaucaagagcuuccccgugaagugcaucgccaagagccacccccuguuccaggaguuccggcuguggcaguucaucaucaaccuccgcauauaccggaaggaccuugcccaggacgucgacgugacgaacgagcugcucaagaccgaggaggacuacguggcucuguucgauuggcugaacggcaagaaggagaucgaccagaaggcguuccugaaguacccggucuucgggcucaagaaagagaucgagaacuaccgcuggaacuacgugcaggacaagcccuaccccugcaacgagacccggagccugaugcuggcgcgccucgagaagugcgacaucuccaucgaguuccugaccaaggagaacgaggaggcccuguggcacauccucuacagcgucgaggacaagaacgagaucgugaaggcccugcagaaguucgccgacaagcacgaccugaacgcguccuucguggacgucuuccagaaguucccgcccuucaagaaagaguacggcagcuacuccgccaaggccaucaagaagcuccucccccugaugcggauggggaaguacuggagcgagaacuccaucgacaagggcacgcgcgagcggaucgacaagaucaucaccggcgaguacgacgagaagauagagaaccgcgugcgggaaaaggccauccaccucgccgacgugagugacuucaaagggcugccccuguggcucgucugcuauaucguguacggacgccacucggaggcgaaggagaucauccaguggaagucgcccgcugacaucgacagcuaccugcggagcuucaagcagcacucccugcgcaacccgaucguggagcaaaucaucaucgagacgcuccgcgucgugcgcgacaucuggaagcagguagggaacaucgacgagauccacguggagcuuggccgcgagaugaagaaccccgccgacaagcggaagaagaugacccagcagaugagcgagaacgagaacacgaaccugcgcaucaaguaccuccugaccgaguuccugaaccccgaguacgagguagagaacgugcggcccuacuccccgagccagcaggacauccuccgcaucuacgaggaggggguccucaauuccgugagcgaccugcccgaggagaucuccgacauccugaagaaguucaccgagaccgaccugaagaagcggcccagccgcagcgaggugcugcgguacaagcucuggcuggagcagaaguaccgcucccccuacacgggcgaggucaucccgcugggcaagcuguucacccccgccuacgagaucgagcacgugaucccccagagcuacuacuucgacgacuccuucagcaacaaggugaucugcgaggcggaggucaacaagcucaaguccaaccugcucgggcacgaguuuaucgugaagcaccacggcgagaucgucgagcugccguucgggaagaagguccggaucuucaccguugacgaguaugagcaguucgugaaggacaauuacagccgcacccgguccaagaugaagaagcugcucauggacgacauccccgaggaguucgucacgcgccagcugaacgacagccgguacaucuccaagguggucaaaagccugcucuccaacauugugcgcgagaagggcgaggaggaggccaucagcaaaaacgugauccccugcaccggcggggugaccgaccggcugaagaaggacuggggcaucaacgaggucuggaacaagaucauccugccccgcuuccagcggcugaaugagcugacagggacgaacaaguucaccaccaagaacgugggcauccaggagaucccgaccaugccccuggaguuacagaagggguucaacaagaagcgcaucgaccaccggcaccacgccauggacgccaucauaauagccugcgcgaaccgcaacaucaucaacuaccugaacaacaaguccgcaaccgccaaggccgagcugagccgguacgaccuccagaagaugcugugcgacaaggccaagacggacaacaacggcaacuauaagugggugauccgcaagcccugggcguccuucacccaggacaccuaccuggcccucgagaacaucaucgucagcuucaagcagaaccugcgcgugaucaacaaggccaccaaccgguuccugcacuacaacgaggagggcaagaagaucuuuguuaagcaggggaagggcgacaacugggccauccgcaaguccaugcacaaagacacggucuucggggaggugaaucuccggcgcauaaagaccguggcccugaacgaggcgaugaagaacccccagagcaucgucgugaaggacuucaagcggaagcugcucgagcuguggaaccugggcuucgacgccaagcgcaucaagaaguacuucgaggacaaccgggagaccuggagcgacaucaaccucuccaagaucgagguguacuacuucagcaaggacacgaaggaccgcuucuucgccacgcggaaaccgcuggacaccuccuucgaccgcaagaagaucgagaacaacauaacggacaccgggauccagaaaauccugcuccggcaccuugagcugaaggacaacaaccccgacaucgccuucagccccgacggcaucgacgagaugaaccggaacaucauccagcucaacaacggcaaguaccaccagccuauaaucaagauccggugguacgagcaggcggacaaguucgccgucgggcagacgggcaacaaguccagcaaguucguggaggccgccaaggggaccaaccuguucuucgccguguacgaauccaacauccuggacaagaaaaccaacaccaucaucaaaaagcgcaacuacgcgacgaucccgcugaacgucgccaucgaacggcagaagcagggccugcccguggcccccgaggacgaaaacgggaacgaccccaucuucgugcugagcccgaacgaccucgucuaccugcccaccgacgacgagcuggccaacggcaucaucgcccagccccucgaccgcggccggaucuacaaaaugguguccagcuccggggagcagugcuucuucaucaagcacaucgucgcgaaugugcugguggacaaguucgaguucagcccccugaacaagauggagcgcgcccucaccggcgagaugaucaagaugaucugcaucccgauuaaggucgacagacugggcaacgugcuggaguccagcuccagcuacaagaaguga

SEQ ID NO: 8060 - RNA, 4515 nt, Artificial Sequence
  Cas9 variant
augaagaacaucgugggccuggaucucgggaccaacagcaucggcugggccgucgugaacggguccgugaaugacgacggcagcgagcaacuggucaagauccaagccucagggucgcguaucauccccauggacgcggccaugaucggcgacuucaacaaagggaacuccaucucgcagaccgccgagcggacgcgccuccgcggggugcggcgucuguccgagcgcuaccugcugcgucgcgaacggcuacaccgcauccuggacauacugggcuuccucccguuccacuucgcccaggaccuugaccggcacggcaagaucgugaagggcaaggagcccaagcuagccuggcgaaagaacgaggcggggcaguucgaguucaucuuccaagacagcuucaaggagaugcucgaggauuucaagcugaaccacccgaaccugaucaccgaugacaaaaagguccccuaugacuggaccauauacuaccuccggaagaaaggccugaccuccaaaaucagcaaggaggaacuugccuggauucuccugaacuucaaccagaagcgcgguuacuaccagcugcgaggggaggaagaggaagagaacaaaaacaaacucguggaguucuaugcccuuaagguggucgccguggaggauagcggcgagaagaaaggaaaggacaucugguacaaugugcaccuggagaacggcugggucuaccggcggacgagcaacaugccacucgacuggguggggaagaccaaggaauuuaucgugaccacugacuuggagaaggacggcacgcccaagaaggacaaggagggcaacguuaagcguuccuuucgggcccccaaggaggacgacuggagccugcucaagaagaaaacggaggcagacaucgaucagacccacaagaccguggggguauacaucuacgauacucugcugggcaaccccucccaaaagauccgcgggcgguugguccguaccaucgagcgaaaguacuacaaagaagaacuaaagcagauccuggagaagcagaaggaguuccaccucgagcugcaggaccgcgcccuguacgccgccugcaucgaagaacucuacccgaucaacgaagcgcaccgcaauaacgugggcaaccgggacuucacguaccuuuuccuggaggacauucucuucuaccaacgcccccucaagagcaagaagucccugaucgacaacugcccauaugaggaaaaucaaggccucgacaaagagaccggggagaucaagagcuucccagugaaauguauagcuaagucucacccgcuguuucaggaguuccgguuguggcaguucaucguaaaucuccggauauaccggaaggaccuggcacaggacguggacgugaccaaugaacugcucaaaaccgaagaggacuaugucgcccucuucgacuggcugaacgguaagaaagagaucgaccagaaggcguuccugaaguaucccguguucggucucaagaaggagauugagaacuaccgcuggaacuacguccaggacaagcccuaccccugcaacgagacccggagccugaugcuggcgcgccucgagaagugcgacaucagcaucgaguuccugaccaaggaaaaugaggaggcccuguggcacauccucuacucuguggaggacaagaacgagaucgugaaggcgcugcagaaguucgccgauaagcacgaccugaacgcuagcuucgucgacguguuccagaaauucccgcccuucaagaaggaguacggcuccuauucugcgaaggcaaucaagaaacuccugccccugaugcggauggggaaguacugguccgagaacagcauugacaagggcacaagggagcggauagacaagaucaucaccggcgaauacgacgagaagauugagaaccgcguucgggagaaggcaauccaccuugcagacgucuccgacuucaaggggcugccccuguggcucguaugcuacaucguguacggucgccacucugaggccaaggagaucacccaguggaaguccccugcggacaucgacagcuaccuucgguccuucaagcagcacucucugcgcaaccccaucgucgagcagauaauaaucgagacccuccggguagugcgugacaucuggaaacaggucggaaacauugacgagauccacguggagcugggccgcgagaugaagaaccccgccgauaagcggaagaagaugacucagcagauguccgagaacgaaaacaccaaccugcgcaucaaguaccuccugaccgaguuccuaaaccccgaauacgagguggagaacgugcggccguacagccccucccagcaggauauccuuagaaucuacgaggaggggguacugaacagcguguccgaucugccggaggagaucucugacauauugaagaaguucaccgagacggaucugaagaagcggcccucccgcagcgagauccugcgguacaagcuauggcuggagcagaaguaccgcagcccuuauacgggagaggucaucccgcugggcaagcuguucacccccgcguacgagaucgaacacgugaucccgcaguccuguuacuucgaugacucauucuccaauaaggucaucugugaggccgaggucaacaagcuaaagagcaaccugcuuggucacgaguucaucgucaaacaccacggcgagaucguggagcuccccuucgguaagaagguccggaucuuuaccguggacgaguacgagcaguucguuaaggacaacuauucccgcacacguagcaagaugaagaaacuacucauggacgacauccccgaagaguucgucacgagacagcugaaugacucucgguacaucagcaaggucgugaaguccuugcucucaaacaucguccgcgaaaagggcgaagaagaagcgaucuccaagaacgugauccccugcacuggcggggugaccgaccggcugaagaaggacuggggcaucaacgagguuuggaacaaaaucaucuuaccgcgcuuccagcggcucaacgagcucacgggcaccaacaaguuuaccaccaagaaugugggcauacaggagauacccaccaugccccuggagcuucagaagggguucaacaagaagcgcauagaccaucggcaucacgcuauggacgcuauuaucaucgccugcgccaaccgcaacaucaucaacuaccugaacaacgagagcgcgacagccaaagccgagcugucccgguacgacuuacagaagaugcugugcgacaaggccaagaccgacaacaauggcaacuacaagugggugaucaggaagccuugggccagcuuuacucaggacaccuaccuagcccucgagaacaucaucgucuccuucaagcagaaccugcgcgugauuaauaaggccacgaaucgguuccugcacuauaacgaggagggaaagaagaucuuugugaagcagggcaagggcgacaacugggccaucagaaagagcaugcacaaggacacugucuucggggaagugaaucucaggcgcauaaagacgguggcccugaaugaggcuaugaagaacccgcagucuauaguugugaaggacuucaagagaaagcugcucgagcucuggaaccugggcuucgacgcgaagcgcaucaaaaaguacuucgaagacaaccgugaaaccuggagcgacaucaaccucagcaagauugagguguacuacuuuuccaaggacacgaaggaucgcuucuucgccacccggaaaccccuggacaccagcuucgaccgcaaaaagaucgagaacaacaucaccgacacggggauccagaaaauccugcuccggcaccuggagcuuaaggacaacaaccccgacaucgccuucucccccgacggcauagacgaaaugaaccgcaacaucauccaacucaacaacggcaaguaucaccagcccaucauaaagauccggugguacgagcaggccgacaaauucgcggucgggcaaacaggcaacaaguucagcaaauucguggaagccgccaaggggaccaaccuguucuuugcuguguaugaguccaacaucuuagauaagaagacaaacacgaucaucaagaagcgcaacuacgcgacuaucccucucaacgucgccauagagcggcagaagcagggccucccuguggcucccgaggacgagaacgguaacgacccgaucuucgugcugagccccaacgaccuugucuaccugcccaccgacgacgagcuagccaauggcaucaucgcccagccccucgaccgcggccggaucuacaagauggugagcugcacaggcaacgaggggcacuucaucccggcgcgcaucgccaaucccauccugcagacgaucgagcuggggagcaacaacaaggcccagaaggccuggaccgacgaaaugaucaaggaaauuugcaugcccaucaaggucgaccggcucggcaacgugcucgaguccagcagcagcuacaagaaguga

SEQ ID NO: 8061 - RNA, 4521 nt, Artificial Sequence
  Cas9 variant
augaagaccauccugggacucgaccuggggcccaacagcaucggcugggccaagguggaggucgacgaugaggggaacuaucugcgcaacaucaaguuaggcucccggaucaucccgaugacccaggacaugcugggggacuucgacaagggcgugaagguaagccagacggccauccgcaccgacuuccggggcaaccgccggcugauagagcgccaccuccugcgacgcgagcggcugcaccgcguccuccacgcgcugaaguuccugcccaagcacuacgaggacgccaucgggugggaccggaacgagcccgccaccuacggcaaguucgugaacaacuccgagccuaagcucgccugggagaggcaggaggacgggagcaugcgauuccuguucauggagagcuucaacgagauggucgccgacuucgcgcagaaccagccgagccuggucuccgacggcaagaagauuccccucgauuggaccaucuacuaccugcgcaagaaggcccugacgcgccccaucaagaaggaggagcucgcuuggauccugcuuaacuucaaccagaagcgcggguacuaccagcuccggggagaggaggaggaggauaaccugacuaagcgcaaggaguacuacaagcugaagguggugggcgucgaggcggacggggcgcccaagggcgggaaaaccugguacaacauccaccucgagaacgguuggaccgcccggugccagagcaagaucccgcucgacgacugggugggcaagguaaaggaguacaucgucacgaccgaguacgaggacgacgggaagaccccgaaaugcgacaaggagggcaaggugaagcgcucuuucaagagccccgagaaggacgacuggcagcugauuaaaacccggacggagaaguucaucgacgacuccaacaagaccgugggggccuucaucuaugauuaccuccuggagaagcccuucgacaagauccgcggcaaguacauccgcaccauugagcggaaguacuacaagaacgagcugcgcgagauccuccgggagcaaaccaaguaccacgaggggcugcacagcuuagaagccuugaagauuugcgccgaggagcuguacaagaacaaccaacagcaccaggaauaccugcucaagaaggacaugacguuccugcugcuuaacgacuuaauuuucuaccagcgcccucugaaauccaagaaaucccucaucgcggacugccccuacgaggucuacaaguacgacgauaagcugaccggcaagaagggacagaagaagaucaagugcaucgccaaaagcaaccccuacuaucaagaguuccggcuguggcaguucaucgccaaccuccgccuguucagcgugaccgacggaaaggaggugaccgccgaguaccuuaagacggaggaggacuauguccgccucuucuccuuccugaacgacaggaaggauaucaagcaggagaccuuccuucggagcuuccugaaacucaagaaggaguccaucggcagcgagaagaucuaccccauccgcuggaacuacaucgaggacgcuaacaagagcuacccgugcaacgcgacccggcacgagcugcugcucgccuucgaccgcgccgacaucccucgugagcugcuggacguagaggagcgcgaguaccggcucuggcaccuucucuauuccaucgaggccaaggaagagaccgagagcgcccuccgcaagcugaaggcgaacaaggccuucggggaccugaacaucgacgacgccuucgugaacuccuuccucaagaucaagcccuucgagaaggaguacggcgccuacagugagaaggccaucaaaaagcugcucgcggucaugcggcgcgggucccucuggaaggaagcagacaucugcgaagccaccaagcagaacaucgccaagauccuucaaaacgacaucgacgagaagcugaaaaagaagaucgaggcggccgugagcuccuucaacaagcucagcgacuuccagggucugcccaccuggcuggcaugcuacguggucuacggccggcauuccgaggcagcccaaauccaguguuggcagagcccggaggacuugaagaccuacaucaacaaguucaagcagcacucgcugcgcaaccccaucgucgaacagugccugcucgagacccugcgcacggucuacgacaucuggaaggaugcggggcagauagacgagauucacaucgaguuaggccggaacaugaaguccaccgccgagcagcgcgcccggaagacuaaggacauccuccgcaacgagaacaccaaccugcggauuaagaaccugcucguggagcuaaagaacgacgacaagaucgagaacgugcgccccuacagccccagccagcaggagauccugcggaucuacgaggagggggccuuacaggagcugaguaaagaggacgagauguucgaggacaucagcaagaucucuaagauggcccagccgagccccacggagcuuucccgcuacaagcucuggcuggagcagaaguaccggucgcccuacaccggccgcgugaucccccugagcaaacucuucaccaccgcguaccagaucgagcacaucaucccgcagucccgguacuucgaugacagcuucaacaacaaggugauuugugaguccgaggugaacagccugaaggacaacaugcugggguaugaguucaucaaggagugcggcggccgcaucguccacugcacgcuccugggggacgugaagaucuucaccaaggaggaguacaaggacuucgugacuaagcacuacaucgacaacaccuauaagcgggacaagcugcuccuggaagacaucccccaggaguucuccgcccgccagcugaacgacagccgguacaucuccaagaugguccagacggugcucagcaacaucgugcgcgccgaaaacgagcaggaagccacguccaaguucgucgugagcuguaacggcgccaucaccaaccggcugaagaaggacugggggcugaacgacgugugguccucuaucgugugcccgcgcuucaagcggcucaacgagaucacgaagaccaacgcguucggccauugggaggacaaggccggaaagcacguguuccagacgacagugccacuggagcugcagcgcggguucuccaagaagcggauagaccaccgccaucacgccauggacgcccucgucaucgcgugcgccagccgcaauaucgugaacuaccuuaacaacgaauccgccaacagccccgagaaacgggaggaccugagaaagaagcuaugcgacgagaagcggaaaauccgcaagcccuggaagaccuucacccaggacgcgcgggaggcccuguccgacgugguagugagcuucaagaacuacgugcgcgucaucaacaaggcgacgaacuacuacgagcacuacagcagcagcggcaacaaggugaugaucucccagaaggggaaugacaugugggccauccggaagccccugcacaaggagagcgucuuuggacgcgucaaccucugccggaaagugaucgugagccugaagaaggcccuggagaacaucccggcuaucugugauaaaacccuccgggacuacaucaaugcccugguagagaagcauuucaacacccggcagcugcucgcgcacuucaagagcaucaacuaccgccuuaacagacagugcguugaaaagguggaggucuggcaguucuccgacgagaagaucgagaugguggcccgccgcaagagccuggacaccuccuucgacgacaagcagaucagcuccaucacggacaccgggauccagaagauccuccuaaacuaccugcagaccaaggacggcaacgccgagaucgccuucacccccgaggguauagaagagaugaacaagaacaucagccuguacaaugacggcaaggcccaccagcccauccugaaagugcgggucgcgacgcccaagggcaugaaguacccgguggggcagacuggcaacaaggccaccaaguucguggucgccgagaaggggaccaaccuguacuucgccaucuacgagaacgagcuuggcgugcgguccuacgacacgaucccccugaacaucguggucgagcgccugaaggaaggccucagccccgugccccaggcgaacgaggccgacaucccgcugaaguucuaccugucccccaacgaccucguguacguccccacgaaggagaacgaggacgagcugugccgggaccgcaucuauaaguucguggacagcucugggacaaccgccaauuucguaccccacacgagcgccaacaccaucuacaacgucgacaaggaguacgccgagaagugcugcaacggcgcgguguuccugaacgaguacgggcucggcuccccacagagcaagaaccaacgcgcccugaccggggagaugaucaaggagaucugcuggaagcugaagguggaccggcucggcaauaucaucaaggucaucaaguga

SEQ ID NO: 8062 - RNA, 4530 nt, Artificial Sequence; identical to SEQ ID NO: 2262
  Cas9 variant

SEQ ID NO: 8063 - RNA, 4530 nt, Artificial Sequence
  Cas9 variant
augaagcgcauccugggccucgaccuggggaccaacucuaucggcugguccuuaaucgaacacgacuucaagaacaagcaggggcagaucgaaggccucggggugcggaucauaccaaugagccaggagauccugggcaaguucgacgccggccaguccaucagccagaccgccgaccgcacgaaguaccgcgggguccggcggcuguaccagcgcgacaaccuccggcgcgagcggcugcaccgcgugcugaagauccucgacuuccugccgaagcacuacuccgagagcaucgacuuccaggacaagguuggccaguucaagcccaagcaggaggucaaacugaacuaucggaagaacgagaagaacaagcacgaguucguguucaugaacuccuucaucgagauggugagcgaguucaagaacgcgcagcccgagcuguucuacaacaaggggaacggcgaggagaccaagauccccuaugacuggacccuguacuaccugcgcaaaaaggcccucacccagcagaucacgaaggaggagcuggccuggcugauccucaauuuuaaccagaagcggggguacuaccagcugcgcggcgaggacaucgacgaggacaagaacaagaaguacaugcagcugaaggucaacaaccucaucgacuccggcgccaaggugaagggcaaggugcuguauaacgucaucuucgacaauggcuggaaguacgagaagcagaucgugaacaaggacgagugggaggggcggaccaaggaguucaucaucaccaccaagacgcugaagaacggcaacaucaaacgcaccuacaaggccguggacagcgagaucgacugggcggccaucaaagccaagaccgagcaggacaucaacaaggccaacaagaccgucggcgaguacaucuacgagucccuccuggacaacccgagccagaagauccgggggaagcuggugaagacgaucgagcgcaaguucuacaaggaggaguucgagaagcuccuguccaagcagaucgagcugcagcccgagcuguucaacgagagccucuacaaggcgugcaucaaggagcuauacccccggaacgagaaccaccaguccaacaacaagaagcagggcuucgaguaccucuucaccgaagacaucauuuucuaccagcgcccccucaagagccagaaguccaacaucagcgggugccaguucgagcacaagaucuacaagcagaagaacaagaagaccggcaagcuggagcucaucaaggagccgaucaagaccauaucccggagccacccccuguuccaggaguuccgcaucuggcaguggcugcagaaccucaagaucuacaacaaggagaagaucgagaacgggaagcucgaggacgugacgacucagcugcuccccaauaacgaggccuacgucacccuguucgacuuccugaacaccaagaaggagcucgagcagaagcaguucaucgaguacuucgugaagaagaaacugaucgacaagaaggagaaggagcacuuccgcuggaacuucguggaggacaagaaguaccccuucagcgagacgcgggcccaguucuugucccgccucgccaaggucaagggaaucaagaacaccgaggacuuccugaacaaaaauacccaggugggcagcaaggagaacuccccguucaucaagcggaucgagcagcuguggcacaucaucuacucaguguccgaccugaaggaguacgagaaggcccucgagaaguucgcggagaagcacaaccuggagaaggacagcuucuuaaagaacuuuaagaaguucccgcccuucgucuccgacuacgccagcuacuccaagaaggcuaucagcaagcuccugcccaucaugcgcauggggaaguacugguccgagagcgcagugcccacccaggugaaggagcggucccuaagcaucauggagcgcgucaaggugcucccccugaaggagggcuacuccgacaaggaccuggccgaccuccugagccgggucuccgacgacgacauccccaagcagcugaucaagagcuucaucuccuucaaggacaagaacccccucaaggggcugaacacguaccaagcgaacuaccugguguacggccgccacagcgagaccggggacauccagcacuggaagaccccggaggacaucgaccgguaccucaauaacuucaagcagcacucccugcgcaaccccaucguugagcaggucgugauggagacccugcgggugguccgcgacaucugggagcacuacggcaacaacgagaaggacuucuucaaggagauccacguggagcucggccgggagaugaagucccccgccgguaagcgcgagaagcugagccagcggaacacggagaacgagaacaccaaccaccgcauccgggagguauuaaaggagcucaugaacgacgccuccgucgagggcggcgugcgcgacuacagccccucccagcaggaaauccuuaagcuguacgaggagggcaucuaccagaacccgaacaccaacuaccucaagguggacgaggacgagauccugaagauccggaagaagaacaaccccacccagaaggagauccagcgcuacaagcuguggcucgagcagggguacauaagccccuacacgggcaagaucaucccccugacgaagcuguucacccacgaguaccagaucgaacacaucauuccacagucccgcuacuacgauaacagccucggcaacaagaucaucugcgaguccgaggucaacgaggacaaggacaacaagaccgccuacgaguaucugaagguggagaaggggagcaucguguucggccacaagcugcucaaucuggacgaguacgaggcccacguuaacaaguacuucaagaagaacaagacgaagcugaagaacuuacuguccgaggacauccccgagggguucaucaaccggcagcugaacgauagccgcuacaucuccaaacucgugaagggccugcugagcaacaucgugcgggagaacggcgagcaggaggcuaccuccaagaaccucauccccgucaccgggguggugaccagcaagcugaaacaggauuggggcuuaaacgacaaguggaacgagaucaucgccccgcgcuucaagcggcucaacaagcugaccaacuccaacgacuucggguucugggacaacgacaucaacgccuuccgaauccagguccccgacagccugaucaagggcuucagcaagaaacggaucgaccaccgccaccacgcccucgacgcccuggugguggcgugcacgucccggaaccacacccacuaccugagcgcccucaacgccgagaacaagaacuacucccuccgcgacaagcuggucauaaagaacgagaacggggacuacaccaagaccuuccagauccccuggcagggcuucacgaucgaggccaagaacaaccucgagaagaccguggugagcuucaagaaaaaccugcgggucaucaacaagaccaacaacaaguucugguccuacaaggacgagaacggcaaccugaaccucgggaaggacggaaagcccaagaaaaagcugcgcaagcagaccaagggcuauaacugggcgauccggaaaccgcugcacaaggagacggugagcggcaucuacaacaucaacgcccccaagaacaagaucgccaccuccgugcgcacucuccugaccgagaucaagaacgaaaagcaccuggccaagaucacggaccuccggauccgcgagaccauccugcccaaccaccugaagcacuaccucaacaacaagggggaagccaacuucagcgaagcguucucccagggcggcaucgaggaucugaauaagaagaucacaacccugaacgaggggaagaagcaccagcccaucuaccgggucaagaucuucgaggugggcagcaaguucuccaucagcgaggacgaaaauuccgccaagagcaagaaguacguggaggccgccaaggggaccaaccucuucuucgccaucuaccuggacgaggagaacaagaagcgcaacuacgagaccauaccgcugaacgaggucaucacccaccagaagcaggucgcgggcuuccccaaguccgagcggcucagcgugcagcccgacucccagaaggggaccuuccuguucacgcugagccccaacgaccucguguacgugccgaacaacgaggagcuggagaaccgcgaccuguucaaccucggcaaccugaacguggagcagaucucccggaucuacaaguucacggacagcagcgacaagaccugcaacuucauccccuuccaggucuccaagcugaucuucaaccucaagaagaaggagcagaagaagcuagacguggacuucaucauccagaacgaguucggccuggggagcccccaguccaagaaccagaaguccaucgacgacgugaugaucaaggagaagugcaucaagcucaagaucgaccgccugggcaacaucagcaaggccuga

SEQ ID NO: 8064 - RNA, 4530 nt, Artificial Sequence
  Cas9 variant
augaagacgauccugggccucgacuuagggaccaacagcgucgggugggccgucaucaacuccgugaucaaggagcaggccgagagaauauggaucgagauggcggggucucggaucauccccauggacgcggccgugcuuggcgacuuugacaaggggaauagcauuagucagacguccgagcgcacccggcuacguggcguccggaggcuucgggagcgccagcugcuccggcgcgagcgacugcacaaggugcugaacauccucggcuuccugccgaaccacuaccuggaguacaucgacuucgagaagcaccccgggaaguuccucagcgacgccgagcccaagcugcccugggugaaggacgaacaggguaaauacaccuuccuguuucaggcggcguucgaugagaugcucgccgacuucgcuauccaccagccgucccuggucagcggggacaagaagauacccuacgacuggaccaucuacuaccugcgcaagaaggcccucacggagaugaucuccaaggaggagcuggcguggauccugcucaacuucaaccagaagcggggcuacuaccagcugcgcggggaggaggaggaagacaacgcuggcaagagcguggaguuuuacgcgcugaaggugcucaccgucgaggccacggacgagaagaagggcagagacgugugguacaacgugcaccuggagaacggguggaucuaccgcagguccagcuccgugccccuggacugggagggccaaaucaaggaguucaucgugaccacggaccucaaccccgacagcaccccgaagcuggacaaguacggggaggugaagagauccuuccgcgccccgaaggaggacgacuggaugcugauaaagaaacgcaccgaggccgacauagccaacacccacaagacggucggcgcuuauaucuacgacacgcucuugcagaagccccaacaaaagaucaucggcaagcuggugaagaccguggagcggaagcucuaccgcgacgagcugagcuuaauccuccagaagcaaugcgccuuccacgccgagcugcaggaccgcacccuguacgcgcggugcgucgaggcccuguaccccaauaacgagguccaacgcaggaacaucgcuaaccgcgacuucguguaucugcugauggacgacguccuauucuaccagcggccgcugaagacgaagaaguccuugauagccaacugccccuacgaggagaacgaguacguggaccgcgagaccggggagaucaagaaagcgccgcuuaagugcaucgccaagagccacccccuguuccaggaguuccggcuguggaacuuccucuccaacauccgcaucuaccagaaggagaaggagaucaacggcacccugcaccuggacguggacgucaccgccgaguuccugaagacggaagacgacuacguggcccucuucgacuggcugaacagccggaaggagauugagcagaagaccuuccugaaguacccaaaguucggguugaagaaggaaaucucaaauuaccgcuggaacuaugucgaggacaagcaguaccccugcaaugagacccggcacgccauccugagccgccuggaaaaggccaacgugugcaucgacuucuuaagcaacgagaaggagguugcgcuguggcacauccuguacuccgucagcgacaaacaggagaucgagaaggcccuccggaccuucgccgccaagaacggacucgacgagucauucguggaggcguucaagaaguucccgcccuucaagagcgaguacggggccuacuccgccaaagccaucaagaaacugcucccccugaugcgcugcggcaaauacugggacgugagcagcauagacgacacgaccaaagagcggauuaagaaaaucgucgccggcgaguacgacgagcgcaucgcggugaagguacgggacaaggucaugaaucugagcgacaucuccugcuuuaagcgauugccccuguggcuggccugcuacaucguguacaaccgccacagcgaggacaaggaggccgugaagugggagucgcccgccgacaucgacgccuaccucgcauccuuuaagcagcauucccugcgcaaucccaucguggagcagguuaucacagagacccugcgcguggugcgggacaucuggaagcaagucggacgcaucgacgagauccacauagagcucggccgggagaugaaaaacccggccgacaagcgcaaacggaugacagcccagauccuggagaacgaaaacgccaaucugcgcaucaaagcccuacuggccgaguucaugaaccccgaguacgaaaucgaaaacgugcggcccuacagcccaucccagcaggagauccuccgcaucuacgaggacauggugcuccacgcugaagaccaacugccggaggagauagacgccauccugaagaaguucaacagcaguaaggugcccaccaagagcgaguuccuccgguacaagcuguggcuggagcagaaguaccgcagcccguacaccggggagcucaucccgcugggcaaacuguucaccgccgcguacgagaucgagcacgugaucccccagucccgguacuucgacgacagcuucuccaacaaggucauaugcgagagcgccgugaacaagcucaaggacaaccagcuuggguacgaguucaucaagaaccaccacggccagaagguugagguuggcuuugguaaguccgucgagaucuucagcguggacuccuaugagcgcuucgucaaggagcaauacgccaagagcgccgugaagaugaagaagaugcugauggacgacauccccgagcaguucauugagcggcagcucaacgauucgcgauauaucucgaaagugaucaaggggcugcuguccaacaucguucgggagaagaacgacuccggggaguacgagcccgaggccguguccaagaacaucguggucuguacgggcagcgugaccgaccgccucaagcgggauugggggaugaaugauguguggaacucgaucgucuacccgcgauucgagagacucaacagcuuaacggacacgcaguccuucggccacugggagaacaagagcggcaaaaagguguuccagacggagcucccccuggaguaucagaagggguucagcaagaagcgcauagaccaccggcaucacgcgauggaugccaucgugaucgccugugccacccgcaaccacgugaacuaccuguccaaugagagugccucccgcaacgcgaagaucucucgguacgaccuccagcgccugcugugcgacaagucccggaccgacgacaacggcaauuacaagugggugaucaagaagcccugggauaccuucacccaggacgcccgcgagguguuaagcaagaucgucgugucccugaagcagaaccugcggaucaucaacaagacaacuaacguguaccgccaccucgaugcaaccgggaaccgggucuacgagaagcagaaaaccggcgacagcugggccauccguaagcccaugcauaaggacacgguguucggggcggugaaccugcggaaggucaagguugugcgacuguccgucgcgcucgacgccccgaccaugauaguggacaagcgggucaagaacaagguguucgagcugcugucuuacaaguacgauaagaagcgcaucgagaaguacuucaaagagaacgccguccucuggaaggaacuggaccuggcgcgggucgcgguguacuacuuuacggaggccaccacggagccccucguggcugucaggaagccccuggacuccacauucaacgagaaaaagauuaaggagagcguaacggacaccgggauccagaagaucuuacucaaccacuuaugcacgaaggagggcaagcccgaccuggccuuuuccgccgagggaaucgaggagaugaaccggaaccucuugcagcugaacaacggcaagcgccaccagccgaucuacaaggugcgggucuacgagccccgcgggaacaaguuuagcgugggcgugcucggcaauaaggguaccaagugggucgaggcggccaagggcacaaaccuguucuucgccaucuauaucaccgaggacgggaagcggacguaugagacaauaccccugaacauggucauagagcgcgaaaagcaaggccucgcccccgugcccgacaaaaacgagaagggggacaagcugcuguucuggcucucccccaacgaccuggucuaccugcccaccgaggaggagcucgaguuuggccgcauuaacgagcccaucgauagaggacgcaucuacaagaugguaagcuccagcgggaaccagugcuucuucaucccacaauccaucagcaacgccauaauccccaccaaggagcugggcgcgaacaacaaggcugagagaagcugggacggggccaugaucaagaacaucugcaucccggugaagguugaucgccucggcaggauaaucgaggugaaguaccgcaucaacgaguga

SEQ ID NO: 8065 - RNA, 4530 nt, Artificial Sequence
  Cas9 variant
augaagacaauacugggccucgaccuggggaccaacuccgugggcugggccguuaucaacagcgugaucaaggagcaggcugagcguauuuggaucgagauggcgggaagccggaucaucccuauggaugccgccguacugggugacuucgacaaggggaacuccauuagccaaacguccgaacgaacgcggcuccgcggcgcucggcgccugcgcgagcgccagcugcuccggcgcgagcgguuacauaagguguugaacauucucggauuccugccgaaccacuaccuggaguacaucgauuuugagaagcaccccgggaaguuucucgccgacgcagaacccaaacuggcgugggugaaggacgagcagggaaaguacaccuuccucuuccaggccgcguucgacgagaugcuagcggacuucgccauacaccagcccagccugguguccggggacaagaagauuccguacgacuggaccaucuauuaccucagaaagaaagcccucacggagaugaucagcaaggaggagcucgccuggauccugcuaaacuucaaucagaagcggggcuacuaucagcugcgcggggaggaggaggaggacaacgccggcaaguccgucgaguucuacgcgcucaaaguucucaccguggaggccaccgacgagaagaagggccgggacgucugguacaaugugcaucuggagaauggguggaucuaucgccggagcuccagcgugccguuggacugggagggccagguaaaggaguucaucgugaccacggaccucaaccccgacgggacacccaagcuggacaaguacggcgaggugaagcgcuccuuucgggccccgaaggaggacgacuggaugcugaucaagaaacgcaccgaggccgacaucgccaacacccacaaaacggucggugcguacauauacgacacccuccuccaaaagccccagcagaagaucaucggaaaauugguuaagacuguugagcgcaaacucuaccgcgacgaacucagccugauccuccaaaagcagugcgcauuccaugccgagcugcaggaccgcgcccuguacgcgcggugcgucgaggcgcucuaccccucaaacgaggugagacggaagaacaucgccaaccgcgauuuuguuuaccuucugauggacgacauccuauuuuaccagaggccccugaagaccaagaaaucccugauugccaacugcccguacgaggagaacgaguacgucgaccgggagacgggagagauuaagaagacgcccuuaaaguguaucgccaagagccaccccuuauuccaggaguucagacucuggaacuucuugagcaacauccgcaucuaccagaaggagaaggagaucaacgguacccuucaccuggacguagacgugaccgccgaguuccuuaagaccgaggacgacuacgucgcccucuucgacuggcugaacucccggaaagaaauugaacagaagaccuuccugaaauaccccaaguuuggcuugaagaaggagaucagcaacuaucgcuggaauuacguggaggacaagcaguacccuugcaacgagaccagacacgccauccugagcucccuggagaaggccaacgucugcaucgacuuccucagcaacgagaaggagguggcccuguggcacauacuguacagcgugagcgacaagcaggagaucgagaaggcgcuccgcaccuucgccgccaagaacggucuggacgagucauucgucgaggcguucaagaaguucccgcccuuuaagucagaguacggcgccuacagugcgaaggcaaucaagaagaugcugccucucaugcgcugcggcaaguacugggacgugucuucuaucgacgauacgaccaaggagcgcaucaagaagaucgugaccggggaguacgaugagcgcauaagcgucaaggugcgcgacaagguuaugaaccuguccgacauaagcugcuuccggcgcuuaccgcucuggcuggccuguuacaucguguacaaccgucacuccgaggacaaggaggccgugaaaugggagagccccgccgacaucgacgcauaccuggccuccuucaagcagcacagccuccgcaacccuaucguggagcaggucauaaccgaaacgcugcgcgugguccgggacaucuggaagcaggucggcagaaucgacgagauccauaucgaacugggacgggagaugaagaaccccgccgacaagcgcaagcggaugaccgcccagauccucgagaacgaaaacgccaaccuacguaucaaggcgcugcucgccgaguucaugaacccggaauacgagaucgaaaacguacggccuuacucccccagccagcaggaaauucugcgcaucuacgaggacaccgugcugcacgcagaggaccagcuaccugaagagaucgacgccaucuugaagaaguucaacuccucaaaggucccgacaaagagcgaguuccugcgauacaaacucuggcuggagcagaaguaccgcucccccuacacgggggaacugaucccccucggcaagcuguucaccgcggccuacgaaaucgaacacgugauaccucagagcagguacuucgacgacuccuucagcaacaagguaaucugcgaguccgcagucaacaagcugaaggacaaccaacucgguuacgaguucaucaagaaccaccacggucagaagguggaggugggguucggcaaaagcgucgagaucuucuccguggauagcuacgagagguucgugaaggaacaguacgccaaauccgccgucaagaugaagaagcugcugauggacgauauccccgaacaguucaucgagcgccagcucaacgauagccgcuacaucuccaagguaaucaaggggcugcugagcaacaucgugagagagaagaacgacucuggcgaguacgaacccgaggcggucagcaagaacaucgugguuugcaccggguccgucaccgaccgccucaagcgggacuggggcaugaacgacguuuggaacagcaucguguacccucgcuucgagcgucugaacucccugacggacacccagagcuucggccacugggagaacaaaagcgguaaaaaggucuuccaaacggagcuccccuuggaguaccagaaaggcuucuccaagaaacgcaucgaccaccgccaccacgccauggacgccaucguaauagcaugcgccacacgcaaccacguuaacuaucuaagcaacgaguccgccagccgcaacgccaagauuucccgguacgaccuccaacgccugcugugcgacaagaacaggacggacgacaacgggaauuacaaaugggucaucaagaagcccugggacacguucacccaggacgcccgcgagguccucagcaaaaucguggucucccugaagcagaaucugcgaauuaucaacaaaaccaccaacguguaccgccaccuagacgccaccggcaacagaguguacgagaagcagaagaccggcgacagcugggccauucgcaaacccaugcacaaggacaccgucuucggggcgguaaaccugcggaaggugaagguugugcgccuguccguggcccucgacacccccgccaugauagucgacaagagagugaagaacaagguguucgagcuccuaucguauaaguacgauaagaagcgaaucgagaaguacuucaaagagaaugcauuucucuggaaggagcuggaccuggcgaagguggcuguguacuacuuuacggaagcgaccaccgagccgcucgucgccgugcggaaaccucuggacuccaccuucaacgagaagaagaucaaggaaucgguuacggauaccggcauacagaagauccugcugaaccaccugugcaccaaagaagguaagccagaccuggccuucuccgcagagggcauugaggagaugaaccgcaaccuacuccaacugaauaacggcaaaagccaccaaccaaucuacaagguccggguuuacgagccuagagggaacaaguucuccgugggcgucuuagggaacaagggcacuaaguggguggaggccgccaaggggacgaaccuguucuucgcaauuuacaucacagaggauggcaagcggaccuacgagaccaucccccugaacgugguaaucgagcgcgagaagcagggacuugugcccgugccggaccgcaacaagaagggcgacaagcugcuguucuggcucagcccgaacgaccuggucuacuugcccacggaggaggagcgcgaguucggccgcaucaacgagcccauagaccgggggcguaucuacaagaugguguccuguaccggcaacgagggccacuucauccccgccaacgucgcgaacccaaucgugcccgugaucgagcuagggagcaacaacaaggcccaaagagccuggaccaacgagaugaucaaggauaucugcauaccuaucaagguggaccgccuggggcacaucaucgagguaaaguacaggaucgacgaguga

SEQ ID NO: 8066 - RNA, 4530 nt, Artificial Sequence
  Cas9 variant
augaagaagauccugggccucgaccuggggaccaacagcgugggcugggccgucaucaacuccguggugaacgacgaggggaaagagcagcuggucaacauaagcuccugcggcagccgcaucauccccauggacgccgcgacccucggugacuucgacaagggcaauuccaagagcccgguggccgagcggacacggcugcggggcgugcgccggcugcucgagcgaucccugcugcggcgcgagcggcuccaccgcguacugagcgugaugggguuccugcccgagcacuacgccgcccagcucgaccgguacggcaaguuccugcccgagaccgagcccaagcucgcaugguacaaggacgagaccgggaaguacagauuuuuguuccaggacuccuucaaugagaugcuggaagacuuccacgagcaccacccggagcugguugcggagggcaagaagauccacuacgacuggaccaucuacuaccuccggaagaaggcccugagccagaagaucaccaaggaggagcuugcguggaucuuacugaacuucaaccagaagcgcggguacuaccaacugaggggcgaggaggagcaggaagacaacaaaaaguccgucgaguacuacgcccucaaggugguggcggucgaggacagcggggaccgcaaggggaaggacaucugguacaacguuaagcuggagaacggcuggguguaccggcgcgccuccggugucccccuggacugggugggcaaggugaaggaguucaucgucacaaccgaccucgacgaaaagggcaaccccaagaaggacaaggacgggaacgugaagcggagcuuccgcgccccaaaggaagacgacuggggccugcugaagacccggacgcaggcccagaucgacgaguccgggcaaacggugggcaccuacaucuacgagagccuccugcgcaugccggaucagaagauccgcgguaagcugguccggaccaucgaacgcaaauacuacaaggacgagcuccggaagauccugaucaagcaguccgaguuccacacggcccugcaggaccacaaccuccugcuugcgugcaucgaggagcucuacccaaacaacgaggcccaccgccggcugcugucuaccuccgauuucaccuacuuccucguggaggacauucuguucuaccagcgcccccucaagucccagaagggccagauagacgacugcccauacgaaagccacguguaccgggacaagaaggacggcuccuugcagcacgucccgcugaagugcgugagcaagucccacccccuguuccaggaguuccgccucuggcacuuccugagcuuccugcggaucuaccagcgcgaacggaugaucgacgggucucugaagcucgacgucgacgugaccaacgaguuccugcagaacgaggacgacuacgugaagcuauucgacuggcucaacgagcgcaaggagaucgaccagaagacuauccuggccuacaagcccuucggccugaagaagaacgagcagagcaaguaccgguggaacuacguagaggacaaguccuaccccugcaauagcacccgcgccgauaugaucuuccgguuauccaaggccggugugccggaggaguuccugacccgggaaaaggaggaggcacuguggcacauccucuacucuaucuccgacaaaaaggaauuaaccaaggcgcugggcacauucgcggagaagaacgggcucaacgaaaccuuuguggagauuuucagcaagaugccacccuucgaguccgacuacgccgccuacagccugaaggcgauccggaagcugcucgcccuaaugcgcaugggcaaguacugggacgagcaggccaucgacgaacacacccggucccgcaucgagaagauucugaccggcgaguacgacgagacgauucggaccaggguccgcgagaaggccaugcaccucaccgacaucagcuccuuccgggggcugccccuguggcuggccugcuacgugguguacgaccgccacagcgaggcgaaggagcuggucaagugggagacccccgacgacaucgaccauuuucugcggaaguucaagcagcacucccuccgcaaccccaucguggagcagaucaucauggagacgcugcggaccgugcgcgacauuuggaagcaggagggcaaaaucgaugagauccacgucgagcuggggcgggagaugaagaaccccgcuaaggagcgcgcccggaucaccgcccaagugcucgagaacgagaacaccaaccugcggaucaaggcgcuguuagccgaauuuaugaaccccgaguucgagaucgagaaugugcggccguacagccccgcccagcaggagauccuacgcaucuacgaagagggcguccuguccgggguggccgagaaggaccuccccgacgacaucgccagcauucugaagaaguuccgggagaacgacgugaagaagcgccccacgaccagcgaggucuugcgguauaagcucuggcuggagcagcgcuacagauccccguacaccggccgcaucaucccccuuggcaagcuguucacacccgcguacgagaucgagcacgugaucccgcagagccgguacuucgaugauuccuucacgaacaagguuaucugcgagagcgccgucaacaagcugaaggacaacugccugggguacgaguucgugaagaagcacuccggcgagaagguggagcuagggaacggcgagaccgccaccaucuucucaguugaggaguacgagcgcuucgugaaggacuccuacuucaacaacucgaagaagaucaagaagcugcugcucgaggacauccccgacaacuucaucgagcgccagcugaacgacucccgguacaucagcaagguugugaagucccugcucagcaacaucgugugcgaggagggcgagcaggaggguauguccaagaacgugaucgucugcacaggcggagugaccgaccgccugaagaaggacuggggcgugcaggacgucuggaaccggaucauccugccccgcuuccuucggcugaacaagaugacggaccgcaccgauuucaccgccgugagcaccaacgggcaccuccugcccgccgugccacuacaccuccagaagggcuucaauaagaagcggaucgaccaccgccaucacgcgauggacgccaucgucaucgccugugccggccggaacaucgucaacuaccugaacaacgccuccgcgcgcaaggggagcgagaucagcagguacgaccugcagcaucuccuuugcgacaaggugaagacggacgccaacggcaacuacaaguggauccugagaaagcccugggagaccuucacccaggaccuguacgccgcccucaccaacaucgucguguccuucaagcaaaaccugcgggugaucaaccgcacgaccaaccacuaccagcacuacaacgaggacggggagaagaagaugaucccucagaccaagggcgaccgccuggcgauccgcaagcccaugcacaaggacaccgucuacggggaggucaaccuccggaaggagaagacgcugccgcugaaggacguggucaagaaccccagcgccgugguggacaaaucccucaagaacaaguuguacgagcuccucaagagccaguacgaucugaaggcaaucaccaaauacuucgagacccaccaggacgucugggccgacgugaaccugaagaagaucaagguguacuacuucaccaaggagacgaaugagcgcuucuucgccacccggaagucauuagacagcuccuucagccagaagaagaucgaggaggagguuaccgacaccggcauccagaagauccugcuccgucaccuccagcagaacggcaacaaccccgacauagcguucucccccgacgggguggagagaaugaaucagaacaugacgauccugaacgacggcaaguggcaccagccaaucuacaagguccggaccuacgagaaggccgacaaguucgccgugggggagaagggcaacaaggugaagaaguucgucgaggccgccaaggggaccaaccuauucuuugcgguguaugagagcauccaggaggacgaagcaaccgguaagcagguccgcaagcggacguucgccaccaucccccucaacgagguuauaaagcgcaagaagcagggccugccggccgcccccgaggacuccaaggggaacuuaccgaucuuugugcucagccccaacgaccugguguaccugccgaccgaagaggagcggaacuccggcaagaucauccaacccuuggaccgcgagcggauauacaagauggucaguuguacugaaggggagugccacugcaucccggaguacguggcgaaccccauccugcagacgaucgagcugggguccaacaacaaggcccagcgcgccuggagcggggagaugaucaaggaaaucugcgugcccgucaaaguggacagacucggcaacgugucccugaucaagaucuga

SEQ ID NO: 8067 - RNA, 4530 nt, Artificial Sequence
  Cas9 variant
augaagaccauccugggccucgaccuggggaccaacagcgugggcugggccgucaucaacuccguuaucaaggagcaagccgagcgcaucuggaucgagacggcggggagccggaucauccccauggacgccgccgugcugggcgacuucgacaaggggaacuccaucagccagaccuccgagcgcacccggcuccgcggcgcccggcgccugcgggagcgccagcugcuccggcgcgagcggcugcacaagguccugaacauccucggcuuccugccgaaucacuaccuggaguacaucgacuucgagaagcaccccgguaaguuccucgccgacgcggagcccaagcuggccugggugaaggacgagcagggaaaguacaccuuccuguuccaggccgccuucgacgagaugcucgcggacuuugccauacaccagcccagccugguguccggggacaagaagaucccguacgacuggacgaucuacuaccugcgcaagaaggcccucaccgagaugaucagcaaggaggagcuggccuggauccugcucaauuucaaccagaagcggggauacuaccagcugcgcggggaggaggaggaggauaacgccggcaaguccgucgaguucuacgcgcugaaggugcucaccguggaggccaccgacgagaagaagggccgggacgucugguacaacgugcaccuggagaacggguggaucuaccgccggagcucaagcgugccccuggacugggagggccaagucaaggaauuuaucgugacgaccgaucucaaccccgacgggacccccaagcuggacaaguacggcgaggugaagcgcuccuuccgggccccgaaggaggacgacuggaugcugaucaagaagcgcaccgaggccgacaucgccaacacgcauaaaaccgucggcgcguacaucuacgacacccuccugcagaagccccagcagaaaaucaucgggaaguuggugaagaccguggagcggaagcucuaccgcgacgagcugagccugauccuccagaagcagugcgcauuccacgccgagcugcaggaccgcgcccuguacgcccggugugucgaggcgcucuaccccuccaacgaggugcgccggaagaacaucgccaaccgcgacuucguauaucugcugauggacgacauccucuucuaccagcggccccugaagacgaagaaaucccugaucgccaacugcccguaugaggagaacgaguacgucgaccgcgagaccggcgagaucaagaaagcgccccucaagugcaucgccaagagccacccccuguuccaggaguuccggcuguggaacuuccucagcaacauccgcaucuaccagaaggaaaaggagaucaacgggacccugcaccuggacguggacgugaccgcggaguuccugaagacggaggacgacuacgucgcccucuucgacuggcugaacucccggaaggagaucgagcagaagaccuuccugaaguaccccaaguucggccucaagaaggagaucagcaauuacagauggaacuacguggaggacaagcaguacccgugcaacgagacccggcacgccauccugagcucccuggagaaagccaacgucuguaucgacuuccucagcaacgagaaggagguggcgcucuggcacauccuguacuccgugagcgacaagcaggagaucgagaaggcccuccgcaccuucgccgccaagaacgggcuggacgaguccuucguagaggccuucaagaaguucccgcccuucaagagcgaguacggcgcguacuccgccaaggccaucaagaaaaugcugccccucaugcggugcggcaaguacugggacgugagcuccaucgacgacacgaccaaggagcgcauaaagaagaucgugaccggcgaguacgacgagcggaucgccgucaaggugcgcgacaaggugaugaaccugagcgacaucuccugcuuccggcgccugccccucuggcuggcaugcuacaucgucuacaaccggcacagcgaggacaaggaggcggucaagugggagucccccgccgacaucgacgccuaccuggccagcuucaagcagcacucccucaggaaccccaucguggagcaggucaucaccgagacgcugcgcguggugcgggauaucuggaagcaggucggccgcaucgacgagauccacaucgagcuggggcgggagaugaagaaccccgccgacaagcgcaagcggaugaccgcgcagauccucgagaacgagaacgccaauuuacgcaucaaggcccuucucgccgaguucaugaacccggaguacgagaucgagaacgugcggcccuacagccccucccagcaggagauccugcgcaucuacgaggacaccguccugcacgcggaggaccagcuccccgaggagaucgacgccauccugaagaaguucaacagcuccaaggucccgaccaagagcgaguuccuccgguacaagcucuggcuggagcagaaguaccgcagccccuacacuggcgagcugaucccccucgggaagcuguucaccgccgccuacgagaucgagcacgugauaccgcagucccgguacuucgacgacagcuucuccaacaaggugauuugcgaaagcgccgucaacaagcugaaggacaaccagcucggcuacgaguucaucaagaaucaccacggccagaagguggaggugggguucggcaaguccgucgagaucuucagcguggacuccuacgagcgcuucgugaaggagcaguacgccaaaagcgccguuaaaaugaagaagcugcugauggacgacauccccgagcaguucaucgagcggcagcuaaacgauucacgcuacaucagcaaggugaucaaggggcugcuguccaacaucgugcgggagaagaacgacagcggcgaguacgagcccgaggccgucuccaagaacaucguggugugcaccgggagcguaaccgacagacucaagcgcgacuggggcaugaaugacguguggaacuccaucguauacccacgcuucgagcggcugaauagccugacggacacccaguccuucggucacugggagaacaagagcgggaagaaggucuuccagaccgagcucccgcuggaguaccagaagggcuucagcaagaagcgcaucgaccaccggcaccacgccauggacgccaucgugaucgcgugcgccacucgcaaucaugugaacuaccuguccaacgagagcgccucccgcaacgccaagaucagccgguacgaccuccagcgccugcugugcgacaagaaccggaccgacgacaacgggaacuacaagugggucaucaagaagcccugggacacguucacccaggacgcccgcgaggugcuguccaagaucguggucagccugaagcagaaccugcggaucauaaacaagaccaccaacguguaccgccacuucgacgcgacagugaaccgggucuaugagaagcagaagaccggcgacuccugggccauccgcaagcccaugcacaaggacaccguguucggggccgugaaccuccggaaggucaagguggugcgccugagcgucgcccuggacacccccgcgaugaucguggacaagcgggucaagaacaagguguucgagcuccuguccuacaaguacgacaagaagcgcaucgagaaguacuucaaggagaacgccuuccuguggaaggagcucgaccuggccaagguggccgucuacuacuucacggaggccaccaccgagccgcugguggcggugcggaagccccucgacagcaccuucaacgagaagaagaucaaggaguccgucacggauaccgggauccagaagauccuguugaaccaccucugcaccaaggaaggcaagcccgaccuugccuucagcgccgaggggaucgaggagaugaaccgcaaccugcuccagcugaacaacggcaagucccaccagcccauuuacaaggugcggguguacgagccgcgcgggaacaaguucagcgucggcgugcugggcaacaaggggaccaaguggguggaggccgccaagggcacgaaccucuucuucgcgaucuacaucaccgaggacgggaagcggaccuacgaaaccaucccccugaacgucgugaucgagcgcgagaagcagggccuggugcccguccccgaccggaacgagaagggggacaagcuccuguucuggcuguccccgaacgaccucguguaccugcccacggaggaggagcgcgaguucggccgcaucaacgagcccaucgaccggggccgcaucuacaagauggugagcugcaccgggaacgagggccacuucauccccgccaacgucgccaacccgaucgugcccgugaucgaguugggguccaacaacaaggcccagcgggccuggaccaacgagaugaucaaggacaucugcauccccaucaaagucgaccgccucggucacauaaucgaggucaaguaccggaucgaugaguga

SEQ ID NO: 8068 - RNA, 4530 nt, Artificial Sequence
  Cas9 variant
augaagaagacauugggccucgaccugggcaccaacuccaucggcugggccgugauuaacuccaacaucgacagcgaagggaaggagaagcuggucggcaucucgagcugcggaucccgcaucauccccauggacgccacgacccucggcgacuucggcaaggggaacaccaagagcccggucgcagagcggacccgccugcggggcauccggcggcugcuugagcgcucccuacugcggcgcgagcgcuugcaccgcgugcugagcgucaugggguuccugcccgagcacuaugccucccagcucgaccgguacggcaaauuccugcccgaaacggagcccaagcuggccugguacaaggacgacagcgggcgcuaccaguuccucuuccagaaguccuuccacgagaugcuggaggacuuucggcagcaccaaccggaacugguggccggcgagaagaagauccccuacgauuggaccauauacuaccuccgcaagaaggcccugagccaggagaucacgaaggaggagcuggccuggauccuccugaacuucaaccagaagcggggcuauuaccagcugcgcggcgaggaggagcaagaggagaacaacaaguccguggaguaccacgcccucaaggucgugagcguggaggacuccggcgagcggaaggggaaagacaucugguacaacgucacccuggagaacggcuggguguaccgucgggccagcaacaucccccuggacuggacgggcaaggugaaggaguucguagugaccaccgagcucgacgacgccgggaaccccaagaaggacaaggaggggaacgugaagcgcuccuuccgggcgccaaaggaggacgacugggggcugcugaagaccagaacgcaggcccagaucgacgaaagcgguaagacugucgggacguacaucuacgagagucugcucugcaugcccaaccagaagauccgcgggaagcuggugcggacgaucgagcgcaaguacuacaaggacgagcuccggcagauccuggugaagcagagugaguuucacgccgcccugcaggaccacaaccuccugcugagcugcaucgaggagcucuaccccaacaacgaggcccaccgccggcugcuguccgcgagcuccuucauauacuuccucaucgaggacauccuguucuaccaacgcccccucaagagccagaagggccucaucgacaacugcccguacgagucccacaucuacaaagacaagaaggacgggagccugcaccacgucccccugaagugcguguccaagucucauccccucuuucaggaguuccggcuguggcaguuccugucgaaccugcgcaucuaccagcgggagcgcaugauggacggcagccuuaagcuggacguggaugucacgcgggaauuucugcccuccgaggaggacuacgugaagcuguuugacuggcugaacgagcgcaaggagaucagccagaaguucuuacucgccuauaagccguucgggcugaagaagaacgagcaggcuaacuaccgguggaacuacguggaggacaaguccuaccccugcaacgagacccgcgccgagaucaagucccggcuguccaaggccggcguccccgaggaguuccucaccgaggagaaggaggaagcgcuguggcacauccuuuacagcaucuccgacaagaaggagcucaccaaggcacuggggacguucgccgccaaaaacugccugaacgagagcuucguggaggucuucgccaagaucccgcccuucgaguccaauuacgcggccuacagccucaaagccauccgcaaacuccuggcccucaugcgcaugggcaaguacuggaacgagcaggccaucgaccgccagacccgggaccgcaucgagaagauccugaccggcgaauaugacgagaccauccgcagccgcgugcgcgagaaggccaugcugcucacggacaucuccagcuuccggggucugccccuguggcucgccugcuacaucguguacgaucgccacuccgagagcaaggagcuggucaagugggagacccccgcugacaucgaccauuuccuguccaaguucaagcagaacagccuccgcaaucccaucguggagcagguuaucaccgagucccugcgcaccgugcgggacaucuggaagcaggaaggaaagaucgacgagauccacguggagcuagggcgcgagaugaagaacccggccaaggagcgggcacgcaucacggcccaggugcaggagaacgagaacaccaaccuccggaucaaggcucugcuggccgaguuuaugaaccccgaguucgaaauugagaacguccacccauacagccccggccagcaggaaauccuccgcauauacgaagacggggugcuguccggcaucgccgagaaggaccuaccggacgacaucacugcgauccucaagaaguuccgggaaaacgacgugaagaagcgccccaccacgagcgagguccugagguacaagcuguggcucgagcagcgcuauaggucccccuacaccggccgcgugaucccgcuggggaagcuguucacccccgccuacgagaucgagcaugugaucccccagagccgguacuucgacgacuccaucagcaacaaggucaucugcgaguccgccgucaacaagcucaaggacaacugccugggauacgaguucaucaagaagcacagcggggagaugguggagcucggcaacggcgagaccguccccguguucuccguggaagaguacgagcgcuucgucaaggagagcuacuuugggaacagcaagaagaugaagaagcuccugcuggaggacaucccugacuccuucaucgagcggcagcucaacgacagccgcuauaucucccgcguggugaccagccugcugucaaaccucgucugcgaggagggcgagcaggacgggcugagcaaaaacgugaucgugugcaccggcgggaucacugaccggcugaagaaggacuggggcgugcaggagguguggaaucgcaucaucuuaccccgguuccugcgccugaacgagauaaccggccggaccgacuucacguccaccagcguuaacgggcaccuccugcccgcccugccccucuaccugcagaagggcuucaacaagaagcgcaucgaccaucggcaccacgccauggacgcuaucgucaucgccugcgccaaccgcaacaucgugaacuaccugaacaacuccagcgcccgaaagaacuccgagaucagccgcuacgaccugcagcggcuacugugcgagaaggugaagaccgacgccaacgggaacuauaaguggauccuccgaaagccgugggagaccuucacgcaggacgucuaugccgccuuaaccaacaucgugguguccuucaagcagaaccuccgggucauuaaccgcacaaccaacuacuaccagcacuacaacgaggccggcgagaagcggaugaucccccagacgaagggagaccgcugggccauccgcaagcccaugcacaaggacaccguguacggagagguuaaccuccgcaaggagaagacccugcccuuacgggacgucgugaagaacccgaguaucguggucgacaagucccucaagaauaaacuguaugagcuguuaaagagucaguacgaucugaaggcgauugcgaaguauuucgagacccaccaggaugugugggccgacgugaaccugaagaagauaaaggucuacuacuuuacgaaggagaccaacgagcguuucuucgcuacccgcaagagccucgaccccagcuucgaccagaagaagaucgaggaggaggugaccgacacgggcgugcagaagauccugcugcaccaccuccagcaaaacaacaaugaccccgacauggccuucucccccgacgggauagaccggaugaaccagaacaugaccauccugaacgacggcaaguggcaccagccgaucuacaaaguacggaccuacgagaaggcggacaaguucgccgugggcgagagcggcaauaaggccaagaaguucgucgaggccgccaaggggaccaaccuguucuucgcggucuacgaaagcgugcaagaggacgaggccaucggcaaacaggucugcaagcggacauucgccaccauccccuuaaacgaggugaucaagcgcaagaagcagggccugcccgccgccccagaggaccugaacgggaaccucccgaaguucgugcugucccccaacgaccuggucuaccuccccacggaggaggagcggaacagcucccgcaucauucagccucuggaccgggaacgcaucuauaagauggugagcuccagcggcucccagugcuucuucaucaagguguucguagcgaacagcaucugggacaagaacgaguacuccagccugaacaaaauggagcgggccaucaccaacgagaugaucaaggagauaugcgugccgaucaagaucgaccgacucgggaacgugucccugauccaaaucuga

SEQ ID NO: 8069 - RNA, 4533 nt, Artificial Sequence
  Cas9 variant
augaagcgaauccugggccucgaccugggcaccaacagcaucggcugggccuuagucgacuccgaggagcagcggauccucgggaugggcagccgcauaauccccauggaccaggggguccuggacaccuucuccggcggcaacccgguggagacgcagaccgccgcgcggaccguguaccgcgggacccgucgccugcgggagcgcgcccuccugcggcgcgagcggcugauccgcguccucaacaugaugaaguuccugcccgagcacuacgccagccagaucgacuucgaaaagagacugggccaguucuucgacgagaaggagcccaagcucgccuggaagcagaacgacgaggggcgcuucgaguucaucuuccagcaguccuucaacgagaugaucgaagaguucaagaacaaaggcgugguccgggaggacaagaagauccccuaugacuggacgaucuacuaccugcgcaagaaggcccugagccaggagaucgagaaggaggaguuagcguggaucuuacugaacuucaaccagaagcggggguacuaccagcuccgcggcgaggaggaggaggagaacccgaacaagcuggucgaguacuacucacugaagaucguggacgugaucgccgacgagaagcccaacagcaaguccgacaucugguacagccuccaccuggagaacggcuggauuuaccggcgcuccagcaagaucccacuguucggguggaaggacaagacccgggacuucaucgucaccaccgaucucaacgacgacggcacugugaagaaggacaaggaggguaucgagaagcgauccuuccgcgcccccagcgagaacgacugggugcugcugaagaaaaagaccgaguccgacaucgagaagucccauaagaccgucggcgccuacguguacgagacccuccugcagaacccgaugcagaaggugcgggguaagcugguccgcacgauugagcggaaguucuacaaggacgagcuaaaacagauccuggagaagcagcgcgaguuucacccugagcugcgggacgaggaccuauacaaugacugcgugcgcgagcuguaccggagcaacgagaccuaccaguucauacucagcaagcgcgacuucgugcaccucuuucuggacgacauccucuucuaccagcggccccuccgcucccagaaaagcgccaucggggacugcauucuggaguucaagaccuacaaggacaaggacggcaacaacaucaaggaguaccugaaggucaucagcaagagcaacccccucuaccaggaguuccgaaucuggcaguggcuguacaaccugaagaucuaccgcaaggaggacgacgaggacgugacccuccaguucaucgccaacaucgaggacaaggaacagcuguucgacuuccugucaaaccggaagaguaucgagcagaagccgcucuuggaguaccugaucaaggccaaggggcugaagaaacaggucaaaacggaggcauaccguuggaacuacguggaagacaagaucuaccccugcagcgagaccaagaccaugaucuccaccagacucgccaagguggagaacauccccgacaacuucuucacgaaggagaucgagcagaagcuguggcacauuaucuacagcgugaccgauaagaacgaguucgagaaggcuuuacgcaccuucgcaaagaaguacgaccucgacaucgccuccuucgucgacaacuucaaaaagaucccgccguucaagaacgaguacggcagcuucuccgagaaggccaucaaaaagcugcugccacucaugcggcuggggaaguacuggaaguggaacgacaucgacaacaacacccagaaccgcauaagcaagaucaucacgggcgaguacgaugaggagaucaaggacaucguccgggagaaguccauugcauuaaccaacgagaacgacuuccagggauuacaacuguggcuggcgcaguaccucgucuacgggcgccauucagaggccgacaucgccggcaaguggcacuccguggccgaccuggagaaguaccugaacgaguucaagcagcacagccuccgcaaccccaucguggagcagaucaucaccgagacccugcgggucguucgcgauaucuggcggaaguacgggcagggcgccgagaacuuuuucuccgagauccauguggaguuagggcgcgacaugaagaacacggcggacgagcggaagaagaucgucaacguggugacagagaacgagaacaccaacuugcgcaucaaggcccugcugauggagcucaagaacaacagcgaugggaagcuggaggucgaaaauguccggccuuacuccccgacccagcaggacauccugaagaucuacgaggaguacgccaucagcacgggccuggacaacgagaaagacgagaaggugaaggaggacauaaagaagauaucccgcgucgcucagcccaccaccaccgagcuucagcgguacaagcuguggcucgagcagaaguauugcagcccguacacggggaaggugaucccgcugggcaaacucuucaccgaagaguaccagaucgagcacauuauccccaagagucgcuacuacgacgacuccuucagcaacaaggugaucugugaggccgccgucaacaagcucaaggacaagugccuggggcuggaguucaucaagaauuaccacggccagaucguggaaaccggguucggccagaaggugaccaucuucgacgaggaggccuaccagaacuucgucaagcagcacuacgcguacaaccacuccaagcggaccaagcuccugcuggaggagauccccgagaagaugaucgaacgccagaugaacgacacgcgguacaucagcaaguucguucucccccugcuguccaaccucgugcgcgccaaggagaacgacaacggcgucaacagcaaaaacguucugccagugaacgggaagaucaccaccaugcugaaacaggacuggggccucaacgacgucuggaacgaccugauucugccccgauucgugcgcaugaacgagcucgcgaagaccauagccuucacguccuggaacgagcagcaccagaaguaucugcccaccgugccccuagagcucagcaagggguuccagaagaagcggaucgaccacagacaccacgcaauggacgcccuggucaucgccugcgcgacucgggaccacgugaaucugcucaacaacaagcacgccaauaccgacacgauccgcuacgaccugcagcggaagcugcgccucuucgagcgcgugaccuacaucgacccacagacuaagaacaacguuacgaaggacauccccaaggaguucaagaagcccugggacaauuucacgguggaugcccggaacgagcuggagaagaucaucguguccuucaagcagaaccugcgcaucaucaacaaggccaccaacauauacaccaaguacgagaacggcaagaagaucaaggucggccagaagggacucaacugggccauccggaagccccugcauaaagagaccguguucgcgaaggugagccugcgcaagaggaagacgguccgccucuccgaggcccugaaggacuggaagaaaaucguggacaaaaagcugaagcaggagaucaagcgucugaccugccaguacggcaaguucgacguggacaccauccugcgcuacuuuaaggaccggaaguaccaguucggggagguggacgugagcaaggugaagauguacuacuucgacgaggagaacgccgccguccgcaaaaacguggacaccuccuuuacggagaaguucauccagggcagcgugaccgacaccggcauccagaaaauccuauuaaaccaucuggaggccaaagggaacaaggucgagaucgcguuuucaccggagggcaucgaggaaaugaacaagaacaucauccagcugaacgaggggaagcugcaccuccccaucuucaagguucggguguacgagaccaucggcaacaaguucagcgucggggugaaggguaacaagaaagacaaauacguggaggccgccaaggggacaaacuuauucuucgccaucuacguggacgagaacggcauccgcuccuacgagaccaucccccucaacaucguaauugagcggcugaagcagggccugagcgucgugcccgagaagaaccgcaaagagcacagccuucuguucuaccuguccccgaacgaccucguguacgucccgaucgaggacgagcgggagaacauccacgcggugaaccuagaccagcugaacaacgagcagcgcaagcgcaucuacaagauggugagcugcacaggguccgagugccacuucguccccuacuacguggccucacccaucgugaacaaggucgaguacuccagccugaacaagaucggacgcucacuaaccggggagaugaucaaggacgugugcaucaagcugaagguggaccggcucggcaacaucaaggggaucagcggccuguga

SEQ ID NO: 8070 - RNA, 4533 nt, Artificial Sequence
  Cas9 variant
augaagcgcauccugggacucgaccuggggaccaacagcaucggcugggcccugguggauuccgaggagcagcggauccucgggaugggcagccgcaucauccccauggaucaggggguccuggacaccuucuccggcggcaacccgguggagacgcagaccgcugcgcggaccgccuaccgcgggacccggcgccugcgggagcgcgcccuccugcggcgcgagcggcugauccgcgugcucaacaugaugaaguuccugcccgagcacuacgcgagccagaucgacuucgagaagcggcugggccaguucuucgacgagaaggagcccaagcucgccuggaagcagaacgacgagggucgcuucgaguucauauuccagcaguccuucaacgagaugaucgaggaguucaagaacaaaggcgucgugcgggaggacaagaagauucccuacgacuggacgauauacuaucugcgcaagaaggcgcugagccaggaaaucgagaaggaggagcucgccuggauccugcugaacuucaaccagaagcggggguacuaccagcuccgcggcgaggaggaggaggagaacccgaacaagcugguggaguacuacucccuaaagaucgucgacgugaucgccgacgagaagcccaauucuaagggcgacaucugguacucccuccaucuggagaacggguggaucuaccggcgcagcuccaagaucccccuguucggcuggaaggacaagacccgggacuucaucgugaccaccgaccucaacgacgacgggacggucaagaaggacaaggagggcaucgagaagcgcagcuuccgcgcccccuccgagaacgacugggugcuacugaagaagaagaccgagagcgacaucgagaagucccacaagaccgugggcgcguacgucuacgagacccuccugcagaacccgaugcagaaggugcgggggaaacuggugcgcacgaucgagcggaaguucuacaaggacgagcucaagcagaucuuggagaagcagcgcgaguuccaccccgagcugcgggacgaagaccucuacaacgacugcguccgcgagcuguaccggagcaacgagaccuaccaguucauccuguccaagcgagacuucgugcaucuguuccuggacgacauccuguucuaccagcggccgcuccgcagccagaaauccgccaucggcgacugcauccuggaguucaagaccuauaaggacaaagacgggaacaacaucaaggaguaccugaaggugaucagcaagucgaacccccucuaccaggaguucagaaucuggcaguggcuguacaaccugaaaaucuaccgcaaggaggacgacgaggacgucaccuuacaguucaucgccaacaucgaggacaaggagcagcuguucgacuuccuguccaaccgcaagagcaucgagcagaagccgcuccuggaguaccugaucaaggccaagggccugaagaagcaggucaagacggaggcguaccgguggaacuacguagaggacaagaucuaccccugcuccgagacgaagaccaugaucagcacccggcucgcgaagguggagaacauccccgacaacuucuucacgaaggagaucgagcagaagcuguggcacaucaucuacuccgugaccgacaagaacgaguucgagaaggcccugcgcaccuucgccaagaaguacgacuuggauaucgcgagcuucguugacaacuucaagaagaucccgccguucaagaacgaguacggguccuucagcgagaaggccaucaagaagcugcugccccuuaugcggcugggcaaguacuggaaguggaaugacaucgacaacaacacccagaaccgcaucuccaagaucaucacgggcgaguacgacgaggagaucaaggacaucguccgggagaaguccauugcgcugaccaacgagaacgacuuccaggggcuccagcuguggcuggcccaguaccucguguacggcaggcacagcgaggccgacaucgccgggaaguggcacagcguagccgaccuggagaaguaccugaacgaguucaagcagcacucccuccgcaaccccaucguagagcagaucaucaccgagacccugcgggugguccgcgacaucuggcguaaguacggccagggggcggagaacuucuucagcgagauccacguggagcugggccgcgacaugaagaacacggccgacgagcggaagaagaucgugaacgucgugaccgagaacgagaacaccaaccuccgcaucaaggcccugcugauggagcuaaagaacaacuccgacgguaagcuggagguggagaacgucagacccuacagcccgacccagcaggacauucugaagaucuacgaggaguacgccaucuccacggggcucgacaaugagaaggacgagaaggugaaggaggacaucaagaagaucucccgcguggcccagcccaccaccaccgagcugcagcgguacaagcuguggcucgagcagaaguacugcucccccuacacggggaaggucaucccccuggggaagcuguucaccgaggaguaccagaucgagcauaucauccccaagagccgcuacuacgacgacagcuucaguaacaaggugaucugcgaggcggccgugaacaagcucaaggacaagugccugggccuggaguuuaucaagaacuaccacgggcagaucgucgagaccggcuucggccagaaggugaccaucuucgacgaagaggcuuaccagaacuucgugaaacagcacuacgccuacaaccggagcaagcgcaccaagcuccugcuggaggagauccccgagaagaugaucgagaggcagaugaacgauacgcgcuacaucucaaaauucguccucccccugcugagcaaccucguccgggcggaggagaacgacaacggggugaacuccaagaacguacugcccgugaacggcaagaucaccaccaugcugaagcaggacugggggcucaacgacguguggaacgaccugaucuuaccgcgcuucguccggaugaacgagcucgccaagaccaucgccuucacgagcuggaacgagcaacaccagaaguaccugccgaccgugccccuugagcucuccaagggcuuccagaagaagcgcaucgaccaucggcaccacgccauggacgcccuggugaucgcgugugccacccgcgaccacgucaaccugcucaacaacaagcacgccaacaccgacacgauccgguacgaccugcagcgcaagcugcgccucuucgagcgggugaccuacaucgacccgcagaccaagaacaacgugaccaaggacauccccaaggaguucaagaagcccugggacaacuucacggucgacgcccgcaacgagcuggagaagaucaucgugagcuucaagcagaaccugcggaucaucaacaaggccaccaacaucuacaccaaguacgagaacggcaagaagaucaagguggggcagaagggccucaacugggcgauccgcaagccccugcacaaggagacagucuucgccaaggugucccugcggaagcgcaagacggugcggcucagcgaggcccugaaggacuggaagaagaucgucgacaagaagcugaagcaggagaucaagcgccugaccugccaguaugggaaguucgacguggacaccauccuccgguauuucaaggaccgcaaguaccaguucggcgagguggacgucuccaaggugaagauguacuacuucgacgaggagaacgccgccgugcggaagaacgucgacaccagcuucacggagaaguucauccagggguccgugaccgacaccggcauccagaagauccugcucaaccaccuggaggcgaagggaaacaagguggagaucgccuucagcccggaagggaucgaggagaugaacaagaacaucauccaacugaacgagggcaaacuccaccuccccaucuucaagguccgcguguacgagaccaucgggaacaaguucuccgugggcgucaaggggaacaagaaggacaaguacguggaggccgccaaggggacgaaccuguucuucgcgaucuacguggacgagaacggcauccggagcuacgagaccaucccccucaacaucgucaucgagcgccugaagcaggggcuguccgugguccccgagaagaaccggaaggagcacagccuccuguucuaccugagcccgaacgaucucguguacguacccauagaagacgagcgcgagaacauacacgccgucaaccuggaccaguuaaacaacgagcagcggaagcgcaucuacaagaugguguccugcaccggcagcgagugccacuucgugcccuacuacgucgccucccccaucgugaacaagguggaguacagcucccucaacaagaucgggcggucucugaccggcgagaugaucaaggacgucugcaucaaacugaagguggaccggcucgggaacgugaagggcaucuccggccuguga

SEQ ID NO: 8071 - RNA, 4536 nt, Artificial Sequence
  Cas9 variant
augaagaagaucuuaggucucgaccuggggacaaacagcaucggcugggccgugauaaacagcgucgccgacgagagcguggagaagcgcaacauagagcuggcgggcucccggaucauccccauggacgccgccgugcucggcaauuuugacaacggggucaccaagagccagacugcggagcgcaccuccuaccggucgauccgccggcugcgcgaacggcagcugcuccgcagggagcgccugcacaaggugcugcagauccucggcuuccugccggagcacuacgugaaugacaucgacuucgagaaccaccccggcaagaucaaaaagaacaccgagccaaagcugcccuggcggaagaacuccauggggcaguucgaguucaucuuucaggccagcuucgaggcgaugcucaccgacuucgccacgcaccagccggucuucguuucugagggcaagaaggugcacuacgacuggacccuguacuaccugcgcaagaaggcccucaccgaggagaucagcaaggaggagcuggcauggaucauccugaauuucaaccagaagcggggguacuaucagcuccgcggcgaggaggaggaggagcaguccaacaagcuggucgaguucuacgcgcugcguguggugaaggucgaggccaccgacgacaaaaaggggaaggacacgugguacaacguacaccucgagaacgguuggaucuaccgccgaaccagcaacauaccccuggacugggagggcaagguaaaggaguucaucgugaccaccgaccugaacgaggacgggacgcccaaacucgacaaguacggcgagguuaagcgcuccuuccgggccccgaaggaggacgacuggacccugaucaagaagaagaccgagagcgacaucgccaacucccacaaaacccugggaugcuacauauacgacgcccugcuacagaauccgaaccagaagaucaagggccgccuggugcgcacggucgagaggaaguucuacaaggaggagcuccgucugauccuggagaagcagcucagcuuccaccccgaguuacaggaccgggaucuguaccgcgcgugcaucgacgcucucuacguguccaacgaggcccacaagaacaacaucagcggccgggacuucguguaccuguucaucgacgacaucaucuucuaccagcgcccccugaagaccaagaagucccucaucgacaacugccccuacgagaagaaccaguacauggaccgggagaccggggaagucaagcaggccccuaucaagugcaucgccaagagccauccccuguuccaggaguuccgccuguggcaguucaucagcaacauccggaucuaccagcgcgagcgggugauggacgacgggaagcuggagaccgacguggacgucacgcccgacuuccuuaagaccgaggacgacuauaccacccuguucgaauggcucaacgaccgcaaggagguggaccagaaggcguuccugaagaacccccaguucgggcugaagaagacguucaccgaguaccgguggaacuacgucgaggacaaguccuacccguguaacgagacccgcaacgccauccucaacggccugcaaaaggccgggguaagcgccgacuuccugucccgcgagguggaagaggcccuguggcacaucuuauacagcgucgaggacaagaucgagaucgaguccgcgcugcgcaaguucgccagcaaacacgaucuggacgaccgcuucgccgacguguucaagaagcucccgccuuucagaaaggaguauggcgccuacagcgccaaggcgaucaagaagcugcugccccucaugcggaugggcaaguauugggagcugagcaacauagacgacaagacgaaggagcgcaucgacaagaucauuacgggggagugggacgagaacauucacaaucgggugagggagaaggcuaucaaacuguccgacaucacagacuucaagggccucccccuguggcugagcugcuacguuguguacaaccgccacuccgaggccagagccaucgcgaagugggagagccccgaggacaucgacuccuaccuccgccuguuccggcagcacagccugcgcaaccccguggucgagcaagucaucaccgagaccuugcggacggugcgcgacaucuggaagcguauugggcaaaucgacgagauccacguggagcugggccgcgagaucaagaaccccgccgacaagcgggccaagaugaccgcccagaucgucgagaacgagaacaccaaccugcgcauaaaggcccuccuggcagaguucaucaacuccgaauaugagauagagaacgugcggccguacagcccggggcagcaggagauccugcgcaucuacgaggacaccguccucaacucaguugaggagaucccggaggacaucagcgccguguuaaagaaguuccgggaauccgaccugaagaagcgccccacuaagagcgaguuccuccguuacaagcuguggcuggagcagaaguaccgcagcccguacacgggcgacaucaucccccucggcaagcuguucaccuccgccuacgagauugagcacaucaucccucagagccgguacuuugacgacuccuucagcaacaaggucaucugcgaggccgaagugaacaagcugaaguccaacgagcucggguacgaguucaucaagaaccaccacggccaguacguggagauuggguucggcaaggucgugcagaucuuuagcauugaggccuacgagaaguucguaaaggcgaacuacuccgggaucgguagcaagaugaagcgccuucugauggacgacaucccggaaaccuucaucgaacgccagcucaacgacucccgcuacaucagcaaggucgugaagucccugcugagcaacaucgugcgggagaaggacuccaacggcgaguacgagcccgaggccaucucaaagaacguaaucgugugcaccggguccgugacggaccgacucaagcgcgacuggggcgucaacgaugucuggaauagcaucauauacccccgguucgagagacugaacgaacugaccggcucucagcaguucggcuguugggagaacaaggagggcaaacggguguuccaaaccgccgugccacucgagaugcagaagggguucagcaagaagcgcaucgaccaucggcaccacgccauggacgccaucgugaucgcgugcgcgauccgcaaccacaucaacuaccugagcaacgaguccgccagcaagaaggccaagauuucccggauagaccuucagcgccuccugugcaccaagugccggacggacgacaauggcaacuacaaauggaucgugaagaagccguggcccgcguucacccaggacauccgcaaggcccuggagaacauaaccgucagcuucaaacagaaucuccgggugaucaacaaaaccacgaacuacuacgugcacuucgacgaguccgggaagaaggucuuggagaagcagaucaacggagacagcugggccauccgcaagcccaugcacaaagacacaguguucgggaagguaaaccugcagaagguuaaggaggugcggcucucccuggcccuggacacccccaagaugaucguggacaaaaagcucaaggagaagguccugcagcuguacucauacaaguaugacaagaagcggaucgacaaguacuucaaggagaacgccucccucuggaaggaccugaaccugagcaagguggcgguguacuacuucaccaacgacuccacggagccgcucgucgccgugcggaagccgcuggacaccagcuucaacgccaagaaaaucaaggaguccgugaccgacaccggcauccagaagauccugcucaaccaccugagcaacaaccaggacaaccccaaccuggccuucuccccugacggaauagacgagaugaaccgcaaccucacaacccugaacgacgggaaguaccaccagccgauauacaagguccgggugugcgaaccgcagggcaacaaguucuccgucgguaccuccggcaacaagaccagcaaguacguggaggccgcuaaggggacgaaccuguucuucgccguguaccagaccgaggacggcaagcgcaacuacgagacuaucccccucaacgucgugaucgaacgggagaaacuugagugggcccccgugccggagaacaacaacaacggcgacaagcuccucuucuggcugagucccaacgaccuggucuacgugcccaccgccgacgagcucaauaacgggaugaggcuggacaacauggacaagggacgcaucuacaagaugaucagcuguagcggcccgcagugcuuuuucaucccgcagaacguguccaaccccaucauccccgucaucgagcugggcgugaauaauaaagccgagaagucguggaacaacgagaugaucaagguggucugcguacccauccggguggaccgccucgggugcaucacgcagaucaacaaccagaaguga

SEQ ID NO: 8072 - RNA, 4539 nt, Artificial Sequence; identical to SEQ ID NO: 2272
  Cas9 variant

SEQ ID NO: 8073 - RNA, 4539 nt, Artificial Sequence
  Cas9 variant
augaagaaaauccugggacucgaccuggggaccaacagcaucggcugggccguggucaacgccgacgagaucacccgcgacgacgggucccgguaccugaagccuaacggcaucagcgcggccgggucccgcaucaucccgaugagcgccgacauccucggcgacuucgagaagggcaacuccaucagccagacggccgagcggacccgcaugcggauggcccgccggcugcacgaacgcgcgcugcuccggcgcgagcggcugcugcgcgugcugaaccugcuggacuuccuccccaagcacuucgccgacaagaucgaccgguacgggaaguucaccgacgacuccgagccaaagcuggccuggcgcaagaacaccgagggcaaguacgaguucauuuuucaggacgccuucaacgagaugcuggccgaguucaaggacaagcagcccgagaucguggaggaggggaaaaagaucccguacgacuggacgaucuacuaccuccggaagaaggcgcuggagaaagcccucagcaaggaggagcucuccuggauccugcugcaguucaaccagaagcgcggcuacuaccagcuccgcggggaggaggaggagaucccccaggacaagaagaucgaguaccuggcccagaaggucgugaagguggaggccaccgaccagaagaagggcgacgacgucugguacaacguguaucuggagaacggcaugaucuaccggcggaccagcaaggcgccccucgacugggaggggaaggugaaggaguucaucgucaccacggagguggagaacgacggcgagaccccaaagaaggacaaggaagggaauaucaagagguccuuccgggccccgaaggaggacgacuggacccugcugaagaagaaaaccgaggccgacaucgagaacagccacaagacggugggcugcuacaucuacgacucccuccugaacaaccccaagcagaagaucaucggcaagcugguccgcaccguggagcgcaaauuuuacaaggaggagcucacccagauccugaagaagcaggucgagcugauccccgagcuccgggacgacaaccuguacaagcagugcaucgaggagcuguaccccaucaacgaggcccaccgcaacaccaucgccaagacggacuucgcgaaccucuuuaucaacgacauccuguucuaccagcggccgcucaagagcaagaagucucagaucgacaacugccccuacgaggagcgcaucuucaucgacagcaagacuggggagaagaagaaggugcccgugaagugcaucgccaaguccaacccccuguuccaggaguuccggcuguggcaguucauccagaaccugcgcaucuaccagcgggaaaaggagaucgacggcaagcuccugaccgacauagacaucaccagcgagugccugaaguccgaggaggacuacgugcgccucuucgacuggcugaacgaccgggagacgaucgagcaggaggaccugcucaagcaccuguucaacaccaagaaguccaagaacaaggagaacccguaccgcuggaacuacgucgaggacaagguguaccccugcaacgagacccgggccaccauccuaaagggguucagcaagugcggcaucaacgccagcgugcugagccccgagcucgagauggcccuguggcacauacuguacuccgucgaggacaagaaggagaucgagacugcguugacccacuucgcccagaagcaaggguggaacgacgacuucgccaagguguucagcaaagccaagcccuucaagaaggacuauggcuccuacagcgagaaggccaucaagaagcugcugucccucaugcgcaugggcaaguauuggaaccaagacaacaucgacaagaacacccuggaccggaucgacaagaucaucaacggggaguacgacgaaaagaucagcaaccgcgugcgggacaacgccaucaaccugaaggauauaucugacuuccgcggccucccggucuggcuggccugcuacaucguguacgacaggcacagcgaggccaaggacugcaccaaguggaacucccccgaggagaucgacagcuaccugaagaaguucaagcagcauucccuccgaaaccccaucgucgagcaggucgugacggagacccugcggaccgugcgcgacauauggauccaggaggagcagaucgacgagauccaccuggagcucgggcgagaccugaagaaccccgccgacaaacggaagaagaugagcgagaacauccugaagaacgagaacaccaaccuccgcaucaaggcgaugcugauggaguucaugaacccguccaugggcaucgagaacgugcgacccuacagccccucccagcaggacauccugcguaucuacgaggagaacgcccucgauaaccugacgaaggacgacaaggacuucgacuucaucagcaagauaaguaagcaggcacagcccagcaagaccgacaucauccguuacaagugcuggcuggagcagaaguaccgcagcccguacaccgggaagaccaucucccucagcaagcuguucacccccgccuacgagaucgagcacgugaucccccagucccuguacuucgaugacucuuuuuccaacaaggucaucugcgaggccgaggugaacaaguugaaggaccggcagcuaggcuacaaguucaucgcggagcaccacggcgagaaggugcagcugagccagggggaggucguggagauccucuccguggacgccuacgagaaguucgucaaggagaacuacgccaacaaccgcaucaagaugaagaaguuacugauggagagcaucccggacgaguucaucgagcggcagcucaacgacucccgcuacaucagcaagguggugaagggccugcuauccaacaucguccgggagaagaucgacgacgagaacuacgagcccgaagccgugagcaaaaaccuaaucuccugcaacggggccaucaccgaccgccugaagaaggacuggggcaugaacgacguguggaacagcaucauccugccccgguucauccgcaugaaccagaucaccgggaaggacugcuucaccaccacgaacgcggagggccaucucaucccccagaugccgcuggagcugcagaagggcuucaacaagaagcggaucgaccaccgccaccacgccauggacgccaucgucaucgccugcaccacccgugaccacgugaaucuccugaacaaugaggccgcgcacuccaaguucaacgccacccgcuaccagcugcagcggaagcuccgucgguucgagaaggccgugaucgacgggaaggagcgugaggucgccaaggaguuccugaagcccugggauagcuucuccagcgacagcaagaacauccuggagaacaucaucguguccuucaagcagaaucagcgcgugaucaacaagacgacaaacgcguuccuccacuucgacgagaacggcaagaagaccuucaucaagcaagggaagggcgacagcugggccauccggaaguccaugcacaaggacaccgucuucggcgagaucaaccugcgcaaggugcgaagcgugucccugaacgaggccaucaagguccccgagcgcgugcucaacaagaagaucaaggagaagaucuuagagcugaagaauaacaagaucgacgccaagaacaucaagaaguacaucgaggagaaccacaccgggggcuaugggaucgacagcuccaagaucgacguguucuacuucacgaaggagaccaaggagcgguucuucgccacccgcaagacgcucgacaccagcuucaaccaggcgaagaucaaggacuccaucgccgacagcggcauccagaagauccugcuggcccaccucaaauccaagaacggggacgccgagcaggccuucagcccagacggcaucgacgagaugaacaagaacaucgucgagcugaacaacggcaaguuccaccaaccgauacugaaggugcggguguacgaaaaggcggacaaguucgccgucgggcagaagggcaacaagaaaguaaaguucguggaggccgccaaggggaccaaucucuucuucgccaucuucgagaaggacggcaagcgcuccuaccugaccaucccccugaacgucaugaucgacugccagaagcaguacgggaaccaguggaagaacaacaucgaggcguaccucaaggagaaggagcugguggagaaggacgugaagcugcaguucauccucagccccaacgaccuggucuaucugccaacggaaggcuccaucgacaagaagcggaucuacaagguggugucauuuaccaacaaccgccucuacgccaucccguacgccaucgccaaguccaucgucgacaagaacgaauuuacccagcugaacaagaucgaguucaccgacaacaaggagagcaucaaggacgcgugcgugcccgugaucaucgaccggcugggcaacgucaucgaguucaacgggaagcgccucuga

SEQ ID NO: 8074 - RNA, 4539 nt, Artificial Sequence
  Cas9 variant
augaagaacauccugggccucgaccuggguacuaacagcauaggcugggccgugaucaacagcgaggaggacgggcccaucgucaagaagcgcaucgagcuggccggcagccggaucauaccgauggacgcggccgugcucgggaacuucgacuccggcgugaccaagagccagaccgcagagcgcaccuccuuccgaagcauccgccgacugcgcgagcggcagcugcuccgccgugagcgccugcacaagguccugcagauccucggcuuccugcccgagcacuacgugaacgacaucgacuucgagaaccaccccgggaagaucaagcgaaacaccgagcccaagcugccguggcgcaagaacuccaugggccaguucgaguucaucuuccaggacagcuucgaggccaugcucaccgacuucgccacgcaccagcccguguucgucuccgaggggaagaaagugcccuacgacuggacccuguacuaccugcggaagaaggcacucaccgagggcaucagcaaggaagaguuagccuggcugauccucaacuucaaccaaaagcguggguacuaccagcugcgcggcgaggaggaggaggagcaaucuaacaaacugguagaguucuacgcucuccgcgucgugaagguggaggccaccgacgacaagaagggcaaggauacgugguauaacguccaccuggagaacggguggaucuaccggcgcaccagcaacauaccccuggacugggagggcaaggugaaggaguucaucgugacgaccgaccucaacgaagaugggacgccgaagcuggacaaguacggcgaggucaagcguucguuccgcgcgcccaaagaggacgacuggacccugauaaagaagaagaccgaaagcgauaucgcgaacucccacaagaccgugggcugcuacaucuacgacgcccuccugcagaacccccaccagaagauuaaggggcggcuggugcgcacggucgagcggaaguucuacaaggaggagcuccggcugauacuggagaagcagcucagcuuccaccccgagcugcaggaccgcgaccuguaccgggccugcauagacgcccucuacguguccaacgaggcgcacaagaacaacaucagcggcagggacuucguguaccuauucaucgacgacaucaucuucuaccagcggccacugaaaacgaagaagucccucaucgacaacugccccuacgaggagaaccaguacauggaccgcgagaccggggaggucaagcaggcccccaucaagugcaucgccaagagccacccccuguuccaggaguuccggcuguggcaguucauaagcaacauccgcaucuaccagcgggagcgcgugcucgacgacggcaaauuagagaccgacguggacgucacgccggacuuccugaagacugaggacgacuacaccacccucuucgagugguucaacgaccggaaggagguggaccaaaaggccuuccugaagaacccccaguucgggcugaagaagacguucaccgaguaucgcuggaacuacgucgaggauaaguccuaccccugcaacgagacccggaacgccauccucaacggccugcaaaaggcgggcgugagcgccgacuuccugucccgcgagguggaggaggcccuguggcacauccucuacagcgucgaggacaaaaucgagaucgagucugcccugcggaaauucgccagcaagcacgaccuggacgaccgcuucgcggacguguucaagaagcugcccccguucaagaaagaguacggggccuacuccgccaaagccaucaaaaagcugcugcccuuaaugcggaucggaaaguacugggagcugagcaacaucgacgacaaaaccaaggagcgcaucgacaagaucaucacgggggagugggacgagaacauccacgaccgcguacgcgagaaggccaucaagcuguccgacaucaccgacuuuaagggacucccccuguggcugagcugcuacgucguuuacaaccgccacuccgaggcgcgggcuaucgccaagugggagucgcccgaggacaucgacuccuaccuccgucuguuccggcagcacucucugcgcaacccgaucguggagcaggucaucaccgagacccuccggacugugcgcgauaucuggaaacggguggggcagaucgacgagauccacgucgagcugggccgcgagaucaagaacccagccgacaaacgggcgaaaaugacggcccaaaucguggaaaacgagaacaccaaucugaggaucaaggcccuccuggccgaguucaucaacuccgaguaugagaucgagaacgugcggcccuacagcuccaaccagcaagagaagcugaagauuuacgaggacaccguacucaacggcgugaaggagaucccugaggacaucaacacgauccugaagaaguuccgcgagagcgaccugaagaagcggccgacaaaguccgacuuccuccacuauaagcuguggcuggagcagaaauacugcagccccuacaccggccgcaucaucccccucgguaagcuguucaccagcgccuacgagaucgagcacaucaucccgcaagcgcacuacuucgacgacaguuucagcaacaaggugaucugcgaggccgaggucaacgggcugaaggacaagaagcucggcuacgaguucaucaaacacaacccggggaagaugguggagauuggcuucggcaagccgcccgugcguaucuucuccgucgaggaguacgagcgcuucgugaaggagaacuacagcgggaucaagaacaagaugaacaaacugcugauggacgacauccccgagaccuucaucgagcggcagcucaacgacucacgcuacaucagcaagguggucaagucccuguuaagcaacaucgugcgggagaaggacaguaacggcgaguacgagcccgaggccaucagcaagaacgugaucgucugcacggggagcgugaccgaccgccucaagcgggacuggggcgugaacgacgucuggaacaguaucaucuacccccgcuucgaacgcuuaaacgaacugacaggcucccagcaguucgggugcugggagaacaaggaggggaagcggguguuucagaccgcagugccccucgagaugcagaagggguucagcaagaagagaauugaccaccggcaccaugccauggaugcgaucgucaucgccugcgccacgcgcaaccacaucaacuaccuguccaacgagagcgccuccaagaaggccaagaucagccggaccgaccugcagcgccuccugugcaccaagugccggaccgacgacaacggcaacuacaaguggaucgugaagaagccguggcccgcguucacgcaggacauccgcaaggcccuggagaacaucaccgugagcuuuaagcagaaucuccgggugaucaacaagacuaccaacuacuacgugcacuucgacgaguccgggaagaaggugcuggagaaacagaucaacggcgacagcugggccauccgcaagccgaugcauaaggacacggucuucggcaaggugaaccugcagaaggugaaagagguccggcucucccucgcccuggacacccccaagaugaucguggacaaaaagcucaaggagaaggugcugcagcuguacagcuacaaguacgacaagaaacgcaucgacaaguacuucaaggagaacgcgucccucuggaaggaccugaaccugagcaaggucgccguguacuacuucaccaacgacuccaccgagcccuuaguggccguccgaaaaccacuggauacuagcuucaacgcuaagaagauaaaagagucugugaccgacaccgggauccagaagauccugcucaaccaccugagcaacaaccaggacgaccccaaccuggccuucucccccgacgggaucgacaagaugaacaagaaccucaccgcacugaacgacgggaaauaucaccagccaaucuacaaggugcgcgucugcgagccccagggaaacaaguucagcguggggacguccggcaauaagaccagcaaguacgucgaggccgccaagggcaccaaccuguucuucgccguguaccagaccgaggacgggaagcgcuccuacgagacgaucccccucaacguggucaucgagcgcgagaagcugggcuggaccccugugccugagaacaacaacaacggggacaaguuacucuucuggcugagccccaacgaccugguguacguccccacagcugacgagcucaacaacggcaugagguuggacaacauggacaaggggcgcaucuacaagaugaucuccugcucaggcccccagugcuucuucaucccgcagaacguguccaacgcgaucauccccgugaucgagcugggcgccaacaacaaggccgagaaguccuggaacaacgagaugaucaaggucgugugcgugcccaucaggguugaccgccucgggugcaucacccagaucaacaaccagaaguga

SEQ ID NO: 8075 - RNA, 4551 nt, Artificial Sequence
  Cas9 variant
augaagaacauauugggccuugaccugggcaccaacagcaucggcuggucugugauccaagagaagcacaacgaaaauaacgagugccagaagcucauccucggggccggcagccgcaucauccccauggacgccgccgugcugggggacuucgccaaaggcaacacuauaucccaaacgaaggaccggacccaguaccgcggugugcggcgccugcgggagcgcugccuucugcggcgcgagcgucuuuuucgcguccucgacaucaugggauuccugccgcagcacuucaguaacgcccugacccgguacggcaaguucaaagacgccgacgaggagcccaagaucgccuggcgcaaggacgaugaggggaagaugcacuuccucuucgcggacuccuucaacgagaugaucgaggaguuccggagcguccagcccgagcuguuaaagcgcggcaugaaggugcccuacgacuggacccuguacuacuugcggaagaaggcaaugcgcgaggccgugacaccguucgagcuggccuggcucauacuguccuucaaccagaagcggggguauuaccagcugagaggcgaggaggagggcgaagcggacaauagcaaguccgaggaauaccucgcccagcgggucguugacgugaucgacaccggggagaagaagggcaagagcaccugguucgacaucguccuggagaacggaaugguguaccaccgccccgccgagaucaagcccgacuggaucggcaagaccaaggaauuuauagugacgacccaguucgacaaggacggcaaccccaagaaggacaaggaggggaacgucaagauguccuuucggaugccgaaugagaacgacuggaacuuacagaagaagaaagccgagaaggacauagacgagagcggcaugaccgugggggaauacaucuacaaugcccuucugcacaaccccaagcagaagauaaagggcaagcuagugcgcgucguggagcgcaaauacuacaagaacgagcuccagaaaauccuagagucccagaagcgguucaucccccagcugagcgacuccgcacucuacgagaagugcaucaaggagcucuaucagagcaacgaggccuaccgcaacuccaucagcacacggaacgacuucacguacuuguucgucgacaacaucauuuucuaccaacgcccccucaaguccaagaagucacuuaucgacaacugcccauacgagagccuggcguacaccaaggacggggaggagcacaaggcccccgugaagugcaucgccaagagccacccccucuaccaggaauuucgucuguggcaguucaucagcaaccuacgcaucuaccagcggcagaagcaggucggcgacaaggucaagcucgacguggacgugaccgaugaguuccugccaaccgacgaccgccgggagucccuguucgacuaccucaacgacaagacggagaucaagcaagacguucugcugaaggaguucuucagcaugaagaagccuaagggcaaggacuccgucuaccccuaccgcuggaacuacguggaggacaagagcuaccccugcaacguuacccgggggaagauccucgcgaagcugaaccgcgccggcaucucugcggacuuccugagcuccaacgggaacgaggagagccucuggcacauccuguacuccguggaggacaaaggcgaguugcggaaggcguuggcccgcuucgcggccaagaacggguuggacgacgccuucaccgaggcccuggccgacaucgaacccuauaagaaggaguacggcgcguacagcgccaaggcccugaagaaguuacugccccugaugcggcucggcaaguacuggaauuacgacaauauagcacccgcgaccaaggcccgcaucuccaagauuauugacggggaguacgacgagaacauccggaacagggugcgagagaaagccaugagccugaacuccgccagccaguuccagggccugccccucuggcuggccugcuacaucgucuacgaucgucacucugagcgcgcggacuccgggcggugguccagucccgaggacaucgacaaauaucugagcgacuucaagcagcacucccuucgcaauccgaucguggagcaggucgugaccgagacccugcggaccgugcgcgacaucuggaaacgguacggcgagaucucagagauccacgucgaacuggggcgcgagaugaagaaucccgccgacaagcgguccaagaugaaccgccgaaugcucgagaacgagaacgccaauaugcgcgcgaagcugcugcucacugaguuuaugaauccugaguucggaaucgagaacguccggagcuacucccccagccagcaggagcugcuccgcauuuacgaggacggcgcuaucuccaaugcgggcagcgagaucgacgacgagaucuccgacaucaugagccggcucucccaaguggacgugaagaagcagccaacggccuccgaggucaagcgcuacauccuguggcucgagcagaacuaccggucccccuacaccggccagaugauaccccucgcgaaguuauuuaccccggcauacgagaucgagcacgugaucccccagagcagguacuucgacgacuccuucagcaacaaggugaucugcgaggccgaagugaacaaguugaaagaccggaugcucggcuacgaguucaucaagcaacacaagggugagaaggugucccugagcaugggcgggaccguggagauccugagccccgaggaguacguccgccacguggagucccaguacaaaaacaacaaggccaagaugcggaagcucuugauggacgacauccccgacgaguucaucaaccgccaacugaacgacagccgauacaucuccaaacuuauaaucagccugcuguccaacaucgugcgcgaggagggcgaggaggaggccaccucuaagaacguaaucucauguaacgggagcaucaccgaccgccucaagaaggacuggggcaucaacgacguguggaaucacaucauccuuccgcgguuccgcagguuaaaugagcucaccggaacugauaaguucacgaccuccaacaaggagggccacgaggugcccgagaugccccuugagcugcagaagggcuucaacaagaagcgaaucgaccaccggcaccacgccauggacgccaucgucauugcgugcaucacccgagaccacgugaaccucuugaacaaugaggccgccaugagcaagaacaacgccaaccggauccagcuguccaagaagcuccgccguuacgaguccgucgagaucgagaaggaugggauacgcaagcagauuuccauggccaaggaguucaagaagcccugggagggcuucaccgccgacgucgaacgaacgcugcgcgacaucguugugagcuucaagcagaaccugagagucauuaacaagaccaccaacuacuaccagcacuucaaggacgggaagaagaucuauuccccgcaaagcaagggcgacucuugggccauccgcaagagcaugcacaaggagaccgucuucggggagaucaacauucggcgcaucaaggaggugucccucaaggaggccaugaagcggaucaaggacaucgccgauaaagagcuacgcagcaagaucgucgagcugauggcccuccaguacaacgagaagaagaucaagcaguacuucagcgacaacaaagacgagugguccgacgugaacccgaagaagaucaaaauucauuacuucaccaaggaaacgaacgagcgguucuucgcgacccgcaagccccuggacaccagcuucgacaagaaaaagaucaaaacccagguagcugacacggccauccaaaagauccugcucaaucaucucuccgcccacggcgacaaggccgagaccgcuuucagccccgauggcaucgacgaaaugaaccgcaacaucaucgagcugaacgacgggaaauuccaccagccgauccucaagguccguaucuacgagaaggccgacaaguacgccgugggccagcagggaaacaagaagaagaaguacguggaggccgcgaagggaaccaaccuguucuucgccaucuacgccgaggagaagauagacgagaagaccggggacacggucauuacccgcacguaugacucuaucccccugaacguggucauugacagagagaagcguggccucagccccguucccgagaacgagaacggcgccaagccaaaguacgugcuuaguccgaacgaccugguguacguccccaacgaggaggagcgggaaaccgggcgcaucugcgagcccuuagacaaggagcggaucuacaagaugguuucguccaacaagaagcaggcuuucuuuaucaaauccgagguggcuuccacuaucgucgacaaguuugaguucagcgcccugaacaagcaggaacgcgcccuguccggcgagaugaucaaggagaucugcaucccgaucagcauuaauaggaucggggagaucacccuccgcuga

SEQ ID NO: 8076 - RNA, 4554 nt, Artificial Sequence
  Cas9 variant
augaagaagaucgucggccuggaccucgggaccaacagcaucggcugggcccugaucaacgccuauaucaacaaggagcaccuguacgggaucgaggcgugcggcucccgcaucaucccaauggacgccgccauccucgggaacuucgacaagggcaacagcaucucccagaccgccgaccggacgagcuaccgcggcauccggcgccugcgagagcgccaccuccuccggcgcgagcggcugcaccgcauccuggaccucuuaggguuccugccgaagcacuacuccgacagccucaaccgguacggcaaguuccugaacgacaucgagugcaagcugcccugggucaaggacgagaccggguccuacaaguucaucuuccaggagaguuucaaggaaaugcucgccaacuucaccgagcaccaccccauccugauugcgaacaacaagaaggugcccuacgacuggaccaucuacuaccugcgcaagaaggcccucacgcagaagaucuccaaggaggagcuggccuggauccugcucaacuucaaccagaagcggggcuacuaccagcugcgcggggaggaggaggagaccccgaacaagcugguggaguacuacucccucaaggucgagaagguggaggacuccggcgagcggaagggcaaggacaccugguacaacgugcaccuggagaacgggaugaucuaccgccggaccagcaacaucccccuggacugggagggcaagacgaaggaguucaucgucaccaccgaccucgaggcugacgggucccccaagaaggacaaggagggcaacaucaagcgcagcuuccgggcccccaaggacgacgacuggacccugaucaagaagaagacggaggccgacaucgacaagaucaagaugaccgugggcgccuacaucuacgacacccuacuccagaagccugaccagaagauccgcgggaagcuggugcggaccaucgagcgcaaguacuacaagaacgagcuguaccagauccucaagacgcaguccgaguuccacgaggagcugcgcgauaagcaguuguacaucgccugccucaacgagcuguaccccaacaacgagccccggcgcaacagcaucuccacccgggacuucugccaccuguucaucgaggacauaaucuucuaucagcgcccccucaagagcaagaagucccugaucgacaacugcccguacgaggagaaccgguacaucgacaaggagagcggcgagaucaagcacgccucaaucaagugcaucgcgaagucccacccccuguaccaggaguuccgccucuggcaguucaucgucaaccugcggaucuaccgcaaggagaccgacguggacgugacccaggagcugcuccccacggaggccgacuacgucaccuuauucgaguggcugaacgagaagaaggagaucgaccagaaggccuucuucaaguacccucccuucggguucaagaagaccacauccaacuaccgguggaacuacguggaggacaagcccuaccccugcaaugagacgcacgcccagaucaucgcccgccucggcaaggcgcacauccccaaggccuuccuguccaaggagaaggaggagacccuguggcacauccuguacagcaucgaggacaagcaggagaucgagaaggcccuccacuccuucgccaacaagaacaaccugagcgaggaguucaucgagcaguucaagaacuucccgcccuucaagaaggaguacggguccuacagcgccaaggcgauaaagaagcugcuccccuugaugcggaugggcaaguacugguccaucgaaaacauagacaacggcacccgcauccguaucaacaagaucaucgauggggaguacgacgagaacauccgcgagcgggugcgccagaaggccauuaaccugaccgacaucacgcauuuucgggcccucccccuguggcuggccugcuaccucgucuacgaccgccacagcgaggugaaggacauagugaaauggaagaccccgaaggacaucgaccuguaccugaaguccuucaagcagcacagccuccggaaccccaucgucgagcaggucauaaccgagacccugcgcacgguccgcgacaucuggcagcaagucggccacaucgacgagauccacaucgagcucgggcgggagaugaagaaccccgccgacaagcgcgcgcggaugucccagcagaugaucaagaacgagaacaccaaccuccgcaucaaggcccugcugaccgaguuccucaaccccgaguucggcaucgaaaacgugcggccguacagccccucccagcaggaccuccugcgcaucuacgaggagggggugcucaacaguauccuugagcuaccagaggacaucggcaucauucucggcaaauucaaccagaccgacacgcugaagcggccgacccgcuccgagauccuacgguacaagcucuggcuggaacagaaguaccgcucgcccuacaccggggagaugauccccuuguccaagcuguucacccccgccuacgagaucgagcacaucaucccgcagagccgguacuucgacgacagccuuuccaacaaggugaucugcgagagcgagaucaacaagcugaaggaccgcucccucggcuacgaguucaucaagaaccaccacggggagaagguggagcuggccuucgacaagcccgucgaggugcugagcguggaggcguacgagaagcucguccacgaguccuacucucacaaccguuccaagaugaagaagcugcugauggaggacauacccgaucaguucaucgagcgccagcucaacgacagccgguacaucuccaagguggucaagucccuccuguccaacaucgugcgcgaggagaacgagcaggaggccaucagcaaaaacgugauccccugcaccggcgggauuacggaccggcucaagaaggacuggggcaucaacgacguguggaacaagaucguccugccgcgcuucauccggcugaacgagcucaccgaguccacccgcuucaccagcaucaacacgaacaacaccaugauccccuccaugccccuggagcugcagaagggcuucaacaagaagcguauugaccaccgccaccacgccauggacgccaucaucaucgcuugcgcgaaccgcaacaucgugaacuaccucaacaacgugagcgccuccaagaauaccaagaucacccggcgagaccugcagacucugcucugccacaaggacaagaccgacaacaacgggaacuacaagugggucaucgacaagccuugggagacauucacccaagacacgcugaccgcccugcagaagauaaccgugagcuucaagcagaaccuccgggugauuaacaagaccacgaaccauuaccagcacuacgagaacggcaagaagaucgucagcaaccaguccaagggggauagcugggccauccgcaaguccaugcacaaagagaccgugcacggcgaggugaaccugcggaugaucaagaccgucagcuucaacgaggcccugaagaagccgcaggcgaucguggagauggaccucaagaagaaaauccuggccaugcuggagcucggcuacgacacaaagcgcaucaagaacuacuucgaagagaacaaggacacguggcaggacaucaaccccuccaagauaaagguguacuacuucaccaaggagaccaaggaccgguacuucgccguccgcaaacccaucgacaccagcuucgacaagaagaagaucaaggaguccaucacagacaccgggauccagcagaucauguugcggcaccuggagaccaaggacaacgaccccacgcucgccuucagcccagacggcaucgacgagaugaaccgcaacauccugauccugaacaaggggaagaagcaccagcccaucuacaaggugcggguguacgagaaggccgagaaguucacggucggccagaaggggaacaagcgcaccaaguucguggaagcggccaagggcaccaaccucuucuucgccaucuacgagaccgaggagauagacaaggacacgaagaaggugauccggaagcgcuccuacagcaccaucccccugaacgucgugaucgagcggcagaaacagggccugucaagcgcccccgaggacgagaacgggaaccucccgaaguacauccugucccccaacgaccuggucuacguccccacccaggaggagauaaacaagggcgagguggugaugcccaucgaccgcgaccggaucuacaagauggucgacagcuccgggaucaccgcgaacuucaucccggccagcacggccaaucucaucuucgccuugcccaaggccaccgcggagaucuacugcaacggcgaaaacugcauccagaacgaguacgguaucgggagcccccaguccaagaaccagaaggccaucacaggcgagauggugaaggagaucugcuucccaauaaagguggaccgccugggaaacaucauccaggucggcuccugcauccucaccaacuga

SEQ ID NO: 8077 - RNA, 4563 nt, Artificial Sequence
  Cas9 variant
augaagaagaucgugggccuugaccucgggaccaacagcaucggcugggcccugaucaaugccuauaucgacgaguacaacaaggagcaccuguacgggaucgaggcgugcggcucccgcaucauccccauggacgccgccauccucgggaacuucgacaagggaaacagcaucucccagaccgccgaccgcacgagcuaccgcggcauccggcgucugcgggagcgccacuuacuccggcgcgagcgguugcaucgcauccuggaccuccugggguuccugccgaagcacuacuccgacagccugaaccgguacgguaaguuccugaacgacaucgagugcaagcugcccugggucaaggacgagaccggguccuacaaguucauuuuccaggagagcuucaaggagaugcucgccaacuucaccgagcaccaccccauccugaucgcgaacaacaagaaggugcccuacgacuggaccaucuacuaucugcgcaagaaggcccucacgcagaagaucuccaaggaggagcuggccuggauccugcucaacuucaaccagaagcggggcuacuaccagcugcgcggagaagaggaggaaaccccgaauaagcugguggaguacuacagccucaaggucgagaagguggaggacuccggcgagcggaagggcaaggacaccugguacaaugugcaccuggagaacgggaugaucuaccgcagaaccagcaacaucccccuugacugggaaggcaagacgaaggaguucaucgucaccaccgaccucgaggccgaugggucccccaagaaggacaaggagggcaacaucaagcgcagcuuccgggcgccgaaggacgacgacuggacccugaucaagaagaaaacggaggccgacauagacaagaucaagaugaccgugggcgccuacaucuacgacacccugcuccagaagccggaccagaagauccgcgggaagcuggugcggaccaucgagcgcaaguacuacaagaacgagcuguaccagauccucaagacgcaguccgaguuccacgaggagcuccgcgacaagcagcuguacaucgccugccucaacgagcuguaccccaacaacgagccccgacgcaacagcaucuccacccgggacuucugccaccuguucaucgaggacaucaucuucuaccagcgcccccucaagucuaagaagucccugaucgacaacugcccuuacgaggagaaccgguacaucgacaaggagagcggcgagaucaagcacgccagcaucaagugcaucgcgaagucccacccccuguaccaggaguuccgccucuggcaguucaucgucaaccugcggaucuaccgcaaggagaccgacguggacgugacccaggagcugcucccaacggaggccgacuacgucacccuguucgaguggcugaacgagaagaaggagaucgaccagaaggccuucuucaaguacccgcccuucggguucaagaagaccaccagcaacuacagauggaacuacguggaggacaagcccuaccccugcaacgagacgcacgcccagaucaucgcccgccuaggcaaggcgcacauccccaaggccuuccuguccaaggaaaaagaggagacccuguggcacauccuguacagcaucgaggacaagcaggaaaucgagaaggcccuccacuccuucgccaacaagaacaaccugagcgaggaguucaucgaacaguucaagaacuucccgcccuucaagaaggaauacggguccuacagcgccaaggcaauuaagaagcuacucccccugaugcggaugggcaaguacugguccaucgaaaacaucgacaacggcacccgcauccggaucaacaagaucaucgacggggaguacgacgagaacauccgcgagcgggugcgccagaaggccaucaaccugaccgacaucacgcacuuucgggcccucccccuguggcuggccugcuaccucgucuacgaccgccacagcgaggugaaggacaucgugaaguggaagaucccgaaggacaucgaccuguaccugaaguccuucaagcagcacagccuccggaaccccaucgucgagcaggucaucaccgagacccugcgcaccgugcgcgacaucuggcagcaggucggccacaucgacgagauccacaucgagcuggggcgggagaugaagaaccccgccgacaagcgggcgcggaugucccagcagaugaucaagaacgagaacacgaaccuccgcaucaaggcccugcugaccgaguuccucaaucccgaguucggcaucgagaacgugcggccguacagccccucccagcaggaccugcugaggaucuacgaggagggggugcucaauagcauccuggaguugcccgaggacaucggcaucauccucggcaaguucaaccagaccgacacccugaaaaggccgacgcguuccgagauccugcgguacaagcucuggcuugagcagaaguaccgcucacccuacacuggggagaugaucccccuguccaagcuguucacccccgccuacgagaucgagcacaucaucccgcaaagccgguacuucgacgacagccuguccaauaaggugaucugcgagagcgagaucaacaagcugaaggaccgcucccucggcuacgaguucaucaagaaccaccacggggagaagguggagcuggccuucgauaagcccgucgaggugcugagcguggaggcguacgagaagcucguccacgaguccuacagccacaaccgguccaagaugaagaagcugcuaauggaggacauccccgaccaguucaucgagagacagcucaacgacagccgguacaucuccaagguggucaagagccugcuguccaacaucgugcgcgaggagaacgagcaggaggccaucagcaagaacgugauccccugcaccggcgggaucaccgaccggcucaagaaggacuggggcauaaacgacguguggaacaagaucguucugccgcgcuuuauccggcugaacgagcucacggaguccacccgcuucaccagcaucaacaccaacaauacgaugauccccuccaugccccuggagcugcagaagggcuucaacaagaagcggaucgaccaccgccaccacgccauggacgccaucaucaucgccugcgcgaaccgcaacaucguaaacuaccucaacaacgugagcgccuccaaaaacaccaagauaacccggagagaccugcagacccugcucugccacaaggacaaaacggacaacaacgggaacuacaagugggucaucgacaagcccugggagaccuuuacccaggacacccugacggcccugcagaagaucaccgugagcuucaagcagaaccuccgggugaucaauaagaccaccaaccacuaccagcacuacgagaacggcaagaagaucgucagcaaccaguccaagggcgacagcugggcgauccgcaaguccaugcacaaggagacggugcacggcgaggugaaccugcggaugaucaagacugucagcuucaacgaggcccugaagaagccgcacgcgaucguggagauggaccucaagaagaagauccuggccaugcuggagcucggcuacgacaccaagcgcaucaagaacuacuucgaggagaacaaggacaccuggcaggacaucaaccccuccaagaucaagguguacuacuucacuaaggagaccaaggaccgguacuucgccguccgcaagcccaucgacaccagcuucgacaagaagaagaucaaggaauccaucaccgacacggggauccagcagaucaugcugcggcaccuggagaccaaggacaacgaccccacccucgccuucagcccggacggcaucgacgagaugaaccgcaacauccugauccugaacaaggggaagaagcaccagcccaucuacaaggugcggguguacgagaaggccgaaaaguucaccgucggccagaaggggaacaagcgcacgaaguuuguggaggcggccaagggcaccaaccucuucuucgccaucuacgagaccgaggagaucgacaaggacaccaagaaggugauccggaagcgcuccuacagcacgaucccccugaacgucgugaucgagaggcagaagcagggccuguccagcgcccccgaggacgagaacgggaaccucccgaaguacauccugucccccaacgaccugguguacguccccacccaggaggagaucaacaagggcgaggugguuaugcccauugaccgcgaccggaucuacaaaauggucgacagcuccgguaucaccgcgaacuucaucccggccagcaccgccaaccucaucuucgcccugcccaaggccacggcggagaucuacugcaacggcgagaacugcauccagaacgaguacgggaucggcagcccccagucaaagaaccagaaggccaucaccggcgagauggugaaggagaucugcuucccgaucaagguggaccgccuggggaacaucauccaggucggcuccugcauccuuaccaacuga

SEQ ID NO: 8078 - RNA, 4563 nt, Artificial Sequence
  Cas9 variant
augaagaagaucgugggccuggaccucgggaccaacagcaucggcugggcccugaucaacgccuacaucgacgaguacaacaaggagcaccuguacgggauugaggcgugcggcucccgcaucauccccauggacgccgccauccucggaaauuucgacaagggcaacagcaucucccagaccgccgaccggacgagcuaccgcggcauccggcgccugcgcgagcgccaccuccuccggcgcgagcggcugcaccgcauccuggaccuccugggguuccugccgaagcacuacuccgacagccucaaccgguacggcaaguuccugaacgacaucgagugcaagcugcccugggucaaggacgagaccggguccuacaaguucaucuuccaggagagcuucaaggagaugcucgccaacuucaccgagcaccaccccauccugaucgcgaacaacaagaaggugccauacgacuggaccaucuacuaccugcgcaagaaggcccucacgcagaagauuagcaaggaggagcuggccuggauucugcucaacuucaaccaaaaacggggcuacuaccagcugcgcggggaagaagaggagaccccgaacaagcugguggaguacuacagucucaaggucgagaagguggaggacuccggcgagaagaagggcaaggacaccugguacaacgugcaccuggagaacgggaugaucuaccggcgcaccagcaacaucccccuggacugggagggcaagacgaaggaguucaucgucacaaccgaccucgaggccgacgggucccccaagaaggacaaggagggcaacaucaagcggagcuuccgcgcgcccaaggacgacgacuggacccugaucaagaagaagacggaggccgacaucgacaagaucaagaugaccgugggcgccuacaucuacgacacccugcuccagaagccggaccagaagauccgugggaagcuggugcggaccaucgagcggaaguacuacaagaaugaguuauaucagauccucaagacgcaguccgaguuccacgaggagcugcgcgacaagcagcuguacaucgccugcuuaaacgagcuguaccccaacaacgagccccggcgcaacagcaucuccacccgcgacuucugccaccuguucaucgaggacaucaucuucuaccagcggccccucaagagcaagaagucccugaucgacaacugcccguacgaggagaaccgcuacaucgacaaggagagcggcgagaucaagcacgccagcaucaagugcaucgcgaagucccauccccuguaccaggaguuccggcucuggcaguucaucgugaaccugcgcaucuaccggaaggagaccgacguggacgugacccaggagcugcuccccacggaggccgacuacgucacccuguucgaguggcugaacgagaagaaggagaucgaccagaaagccuucuucaaauauccgcccuucggguucaagaagaccaccagcaacuacagguggaacuacguggaggacaagcccuaccccugcaacgagacgcacgcccagaucauuacccggcucggcaaggcccacauccccaaggcguuccuguccaaggagaaggaggagacccuguggcacauccuguacagcaucgaggacaagcaagaaaucgagaaggcccuccacuccuucgccaacaagaacaaccugagcgaggaguucaucgagcaguucaagaacuucccucccuuuaagaaggaguacgggucuuacagcgccaaggccaucaagaagcugcucccacugaugcgcaugggcaaguacugguccaucaaaaacaucgacaacggcacccggauccgcaucaacaagaucaucgacggggaguacgacgagaacauccgggagcgcgugcggcagaaggcgauuaaccugacggacaucacccacuuccgcgcccucccccuguggcuggccugcuaccucgucuacgaccggcacagcgaggugaaggauaucgugaaguggaagaccccgaaggacaucgaccuguaccugaaguccuucaagcaacacagccuccgcaaccccaucgucgagcaggucaucaccgagacgcugcggaccgugcgcgacaucuggcagcaggucggccacaucgaugagauccacaucgagcuggggagggagaugaagucccccgccgacaagcgggcccgcaugagccagcagaugauaaagaacgagaacaccaaccugcggaucaaggcgcugcugaccgaguuccucaaccccgaguucggcaucgagaacgugcgcccguacucccccagccagcaggaccugcugcggaucuacgaggagggggugcucaacuccauccuggagcuacccgaggacaucggcaucauccucggcaaguucaaucagacggacacccugaagcgcccgacccggagcgagauccugcgcuacaagcucuggcuggagcagaaguaccggucccccuacaccggggagaugaucccccugagcaagcuguucacccccgccuacgagaucgagcacauaaucccgcagagccgcuacuucgacgacucccugagcaauaaggugaucugcgaguccgagaucaacaaguuaaaggaccggagccucggcuaugaguucaucaagaaccaccacggggagaagguggagcuggccuucgauaaacccgucgaggugcuguccguggaggccuacgagaagcucguccacgagagcuacucgcauaaccgcagcaagaugaagaagcugcugauggaggacauccccgaucaauucaucgagcggcagcucaacgacucccgcuacaucagcaagguggugaagucccugcugagcaacaucguccgggaggagaacgagcaggaggcgaucucgaagaacgugauccccugcacgggcgggauaaccgaccgccuaaagaaggacuggggcaucaacgacguguggaacaagaucguccugccgcgguucauccgccugaacgagcucaccgagagcacccguuucacguccaucaacaccaacaacaccaugauccccagcaugccccuggagcugcagaagggcuucaacaagaagcgcaucgaccaccggcaccacgccauggacgccaucaucaucgccugcgccaaccgcaacaucgugaacuaccucaacaacguguccgcgagcaagaacaccaagaucacgcgccgggaccugcagacccugcucugccacaaggacaagaccgacaacaacgggaacuacaagugggucaucgacaagcccugggagaccuucacgcaggacacccugaccgcccugcagaaaaucaccgugagcuucaagcagaaccuccgcgugaucaacaagacgaccaaccacuaccagcacuacgagaacggcaagaagaucgucuccaaccagagcaaaggggacuccugggccauccgcaagagcaugcacaaggagaccgugcacggcgaagugaaccugcggaugaucaagaccgucucccugaacgaggcccucaagaagccgcaggccaucguggagauggaccugaagaagaagauccuggcgaugcucgagcugggcuacgacacgaagcggaucaagaacuacuucgaggagaacaaggacaccuggcaggacauuaaccccagcaaaaucaagguguacuacuucaccaaagagaccaaagaccgcuacuucgccguccggaagcccaucgacacgucuuucgacaagaagaagaucaaggagagcaucaccgacaccggaauccagcagaucaugcugcgccaccucgagaccaaagacaacgaccccacgcuggccuucuccccggacggcaucgacgagaugaaccggaacauacucauccucaacaaggggaagaagcaccagcccaucuacaaggugcgcguguacgagaaggccgagaaguucacagucggccagaaggggaacaagcggaccaaguucguggaggcugcgaaggggaccaaccuguucuucgccaucuaugagacggaggagaucgacaaggacaccaagaaggugauccgcaagagaagcuacuccaccaucccccugaacgucgugaucgagcggcaaaagcagggccucagcuccgcccccgaggacgagaacgggaaccugccgaaguacauccugagccccaacgaccucguguacguccccacccaggaggagaucaacaagggcgagguggugaugcccauugaccgggaccgcaucuacaagauggucgacuccagcgggauuacggccaacuucaucccggcauccaccgccaaccugauauucgcccugcccaaggccaccgccgagaucuacugcaacggcgagaacugcauccagaacgaguaugggaucggcagcccccaguccaagaaccagaaggcgaucacaggcgagaugguaaaggagaucugcuucccgaucaagguggaccgguuggggaacaucauccaggucggcagcugcauccuaaccaacuga

SEQ ID NO: 8079 - RNA, 4575 nt, Artificial Sequence; identical to SEQ ID NO: 2279
  Cas9 variant

SEQ ID NO: 8080 - RNA, 4581 nt, Artificial Sequence
  Cas9 variant
augaagaagauccugggccucgaccuggggaccaacagcaucggcugggccgugcugaacgccgcggacgacaacucccucaaauacaucgaggccgccgggagccgcaucauccccauggacgccgccauccugggcgacuucgaccggggaaacuccaucagccagaccgcggagcgcacgcggauccgcggcaugcggcaccuccgcgagcgguaccuccugcgucgggcccgccugcaccggauccugaaccugcugggcuuccucccguuccacuacgcccaggacaucgaccgguacgggaacuucuccgccgacauggagcccaagaucgcguggcggaagaaccuggagggcgagcuggaguucaucuucaucgagagcuuuaacgaaaugcucgaggacuuccgcaagaaccagcccgagcuggucgccgacaacaagaaggugcccuacgacuggguaaucuacuaccugcggaagaaggcccucgagaagaagaucuccaaggaggaacuggccuggauccugcucaacuucaaccagaagcgcggguacuaccagcugcggggcgaagacgacgacgaaagcaugaagaccgcaaagacccgccaguacuuugacaagcaaaucaucaaaaacaucaucgacaccaaccagacguacaaggggcagcggauccugaucgucgagcuccagaacggcgacaagggcaagaucuucaagaaggagaucccggacuggaucgggcaggagaagaacaucaucgugaccguggacaucgacaaggacggcaacgacaaguacgaggaguccgggagccuguccugccgcuucaagauccccaccgacgcggagugggaaagcgaguggaagcugaucaaaaugaagacccagaaggacuuggacgaauccaacaagacggucggcaccuacaucuacgacagcaucuugcagaaccccacccagaaggugcggggcaagcuggugcgcaccaucgagcgcaaguacuacaaggccgagcucaagcagauacuggagaagcagacggaguuccacuccgagcugcaggacaaggaccucuacaucgagugccugaacgagcuguacagcaacaacgacacccaccggaaugccaucaccgaccgcgacuucgucuaccucuucaugaacgacauccuguucuaccagcgcccccugaaauccaaaaagucacucaucgacaacugccccuacgagcgcaacaucuacaucgacaaggagaccggggagaucaaauacucccccaucaagugcauagccaagagccacccccuguuccaagaguuucggcuguggaaguucaucagcuccauccgcaucuaccagcgggagagcgugguggaggucguggacaagcagcucgaccuguucuccagccaguccacgagcgugcagaagcuggucaccgacguggacgugaccgacaaguuccugaccugcgagaacgauuacgucgcccuguucgaguggcugaacaagaagaagaucaucgaccagaaggaguuccucaaguaccgccccuucggccugaagggggacaucgacaacuaccgguggaacuacguggaggacaaguccuacccgugcaacgagacgcacgcgaugauccugaccuacuucgccaaggccggcauuagcgaggacauccugaccaaggagauggaggaggcccucuggcacauccuguacuccguggaggaccgccaggagaucaccaaggcccugcggacguucgcgucuaaguaccaccucuccgacagcuucgucaagguguucuccaacaucccgcccuucaagaaggaguacgggagcuacuccgccaaggccaucaagaagcugcugagcuugaugcgcaugggcaaguacugguccgaggacgccaucgacgugaacacccgggagcgcaucgacaagauagucaccggcgaguacgacgagaagauccgggaccgcgugcgggagaagaccauccgccugaacgacauccggcacuuccgcgcccugcccgacuggcucgcguguuacgucguguacgaccgccacagcgagacgcgggagaucaccgaguggaagucccccgaggagaucgaugaguacauccgcaacuucaagcaacacagccugcggaaccccaucguggagcaggucauuaccgagacccugcgcacggugcgggacauauggaagcagguagggugcaucgacgagauccacguggagcucggccgcgagaugaagaaccccgccgacaagcggaagcgcaucaccagccagaucaucgagaacgagaacgccaaccugcgagugaaggcccugcucaccgaguucgugaaccccgaguucgagaucgagaacguccgcccguacucccuggggcagcaggacauccugcggaucuacgaggacggcgugcucaacagcguggcggagguccccggggacaucgccggcauccugaagaaguucaacgagaacgaugccaagaagcgccccaccacguccgagauccugcgguacaagcuauggcuggagcagaaguaccgcagccccuacacuggcgagaugaucccgcuguccaagcuguucaccagcgccuacgagaucgaacacgugaucccccagucccgguacuuugacgacagcuucuccaacaaggugaucugcgaggccgaggucaacaagcucaaggacaacgcgcugggguacgaguucaucaaaaagcaccacggcgagaagguggagcucggguucggcaagaucguggagaucuucagcgucuccguguacgagcaguucgugaaggacaacuacagcagaaaccgggggaagaugaagaagcugcugauggacgagauccccgagcaguucaucgagcgccagcucaaugacucccgguacaucucaaaggucgugaagacccugcuguccaacgugguccgcgagaaggccgagcaggaggccgugagcaaaaacgugaucguuugcaccggcggcgugacggaccggcucaagaaggacugggggaucaacgacguguggaacaagaucguccugccccgcuuccugcgccucaacgagcugaccaacucgaccaacuuuaccgccaagaacgccgcgggcaacgagaucccggccaugccccuggagcuccagaagggguucaacaagaagcggaucgaccaccgccaccacgccauggacgccauugugaucgccugcgcgaaccggaacaucgugaacuaccugaacaacgagagcgccucacgcaaggccaagaucucccggcacgaccugcaggcgauucucugcgacaagguccgcacggacgacaagggcaacuaccaguggcgggugaagaagcccugggacaccuucacccaggacguguacgucgcucuggagaacaucaucguuagcuucaagcagaaccugcgcgugaucaacaagaccuccaacuacuacuggcacuaugaaaacggcaagaaggucuuggugaagcaggucaagggggacagcugggccauccggaagccgaugcacaaggacacgguguucggcgaggugaaccugcgcaagguaaaguccgucagccugaacgaggcccucaagaacccccaguucaucguggagaaggaccugaagcggcagcuccucucccugcugcagcagaacuucgacaucaagaagaucaagaaguacuucgaggagcacaaggacaucuggagcgacaucucccucagcaaaaugaacaucuacuacuucaccaaggagaccaaggaccgcuacuucgccacacggaagccccuggacgccucuuucgacaagaaaaagaucgagagcugcaucacggacaccgggauccagcagauccugcuccgccaccuggagcugaaggagaacgacccggagcgggcguucuccccggacggcaucgacgagaugaaccgcaacaucauccagcucaacaaggggaagggccaccaccccaucgccaaagugcgggucuacgagaaggccgacaaguucgaggucggccagcgcgggaacaagagcuccaaguucguggaggccgccaagggcaccaaccuguucuucgcggucuacgagaccgaguaucccgacgaaaagacgaacagcaucgugcggaagcgaaacuacgccaccaucccccugaacaucgccaucgagcgccagaagcgggggcucuccaccgccccggaggacgagaagggcaacguccccagcuucgugcugagucccaacgacuugguguaccuccccaccagcgaggacaucgucaacgggcacaucacgcagccgaucgacaagagccgcaucuacaagaugguguccagcuccggcagccaguguuucuucaucaagcacaacaucgccaacaucaucguggacaaauacgaguucagcccccugaacaagauggagcgggcgaucagcaacgagaugaucaaggagaucugcauccccgugaaaguggaccgccugggcaauaucgugaaguuggggaaguccgaguga

SEQ ID NO: 8081 - RNA, 4581 nt, Artificial Sequence; identical to SEQ ID NO: 2281
  Cas9 variant

SEQ ID NO: 8082 - RNA, 4584 nt, Artificial Sequence
  Cas9 variant
auggcaaagaucuugggccucgaccuggggacaaacucuaucggcugggccaucguggagaaggacgggaacgacuucucucuggucgacaagggcgugcgcaucuucagcgaggggguaaaguccgagaagggcaucgagagcucccgggcggccgagcgcaccggcuaccguagcgcccgcaagaucaaguaccggcgcaagcuccggaaguacgagacgcugaagguccugucccucaacgggaugugcccccugagcaucgaggagguggaggaguggaagaaguccggcuucaaggaauacccgcuaaaccccgaguuccucgagugguuacgcaccagcgacgacgagaacaucaaccccuacuucuuccgggacaaggccuccaagcagaaggugacucuguucgaggucgggcgcgccuucuaccacauugcgcagcggcgcggcuuccucagcaaccggcucgaccaguccgccgaggggauccuggaggagcacugccccaagaucgaggcccucguggaggaucugaacagcaccgaugagauccugacgucccucaaggauuacuucuucgacacaggcauccuggacgccaacgagaagggcggguucgcgaaggaccuggacgagggcgacaagaagcucgugagccuguaccgcuccauccaggccaucgucaagaagaacgacaccgacuucgagaaggguaaggccgagaucaucgagcgucugaacaagaaggacgugcucggcaaggugaagggcaagaucaaggacaucagccaggccaugcuggaggggaacuucaagacccugggccaguacuucuucucccucuacaacaaggagcgcauccggaaccaguacacgagccgcgaggaccacuaucuggaggaguucaagaucauaugcaaguuccaggggaucggcagcaucaaccagaaugagaagcugccggagaagaaguucgaggggcucgccaaggagcuguacaaagcgaucuucuuccagcggccccugaagucccagaagggccucaucggcaagugcagcuucgagaaguccaagagccgcugcgcuaucucccaccccgacuucgaggagaagcggaugugggaguaccugaacaccaucaagaucgggacccagagcgagaagguccugcgcuuccucucccaggaggaaaagcugaaccugauccccaaguuccuccgcaagaaggacaauuucaacuucgaggaccuggccaaggagcugaucgagaagggcgccaccuucggguucuacaaaagcuccaagcgggacagcuuccacuacugguucaacuacaagccgacggacaccguguccggaugccccgugagcgccucccucaagagcgucgugggggaggacuggaagaccaaguccuucaucuacaagaccacgaacagcaagggcaucgaaguaucccgcaccgucaacuauaaggaccucuggcaccuccucagcguauccaccagcgacaucuaccuguacgaguacgcgaagaacaaacugggccucgaggacaagaacgccaaggccuucagcaagaucaagcugaagaaggacuucgggaacuugucccugaacgccaucaacaagauccuccccuacaugcgggagggccugcuguacagccacgccguguucauggcuaacaucgaguccaucgucgacgaggugaucuggaacgaccucgggcagcgcaaguacauccaggacaagaucgccgccaucaucgccaacaacaucguggacaacggccugcuggaggucgugaacgggcucaucaaggagugcaaggucgacggcgccuacuacagcaaggaggcggccgacaccuaccggaaggaccugucuaagaagcugguuagcuucuucaaguuccaccacauagacgacggcaucaagcaggagacgauccucaacgagcuguuccccguguucaucgagcagcugaaggcccacgaguucaucaaggucaagcgccucgacgagaaggugcuggaguuccugaagggggaaaaccaggacggcgagguguucugcaacaacgccaagcaacucaagaagcuguaccacccguccgacaucgaggucuucaagaaacagaucgugaaggacaaggacgggaccgagaccggccagcugauccugggcucuccccugaccuccagcaucaagaaccccauggcgaugcgggcccugcaccagcuccgcaaggugcugaacacgcugaucgucgaggaacaggucgacuccagcacccggauccacaucgagauggcccgcgagcucaacgacgccaauaagcggaaggggauacaagacuaccagaacgagaacaagaaggagcgcgagaaguacagggacgagaucaagaagcuguaccuggccgagugcaacaaggagaucgagcccaccguggacgaccuccugcgcuaccagcuguggauagagcaggaccggaaggagaucuaugagaacggcaacuccaucagcaucugcgacaucaucggggacaacccggcguacgacaucgagcacacugugccccgcuccaucagccaggacaacucccagaugaacaagacgcucugcagccagaaguucaaccgggacgugaagaaacagaagaugcccuucgaacugggcaaccaccuagagauccucccccggaucgcccacuggaaggaggaggccgacaaccugagccgggaaaucgagaugaucauccgcagcaccaagaccgccgccaccaaggaggcgaaggacaagaagauccgccggcgccacuaccugacgcuccggcgcgacuaccugcaggggaaguacgaccgauucaucuggaccgagccgaaggugggcuucaagaacagccagauccccgacacaggcaucaucacccgcuacgcgcaggccuaccugaaaagcuacuuuaaccgggucgagagcguaaagggcgggaugguggccgaguuucgcaaaaucugggggauccaggaguccuaccaggagaacggcaagaaguauuucaaggagaaggaccggagcaagcacacacaccacaccaucgacgcaaucaccaucgcgugcaugaccaaggacaaguacgacguccucgcccacgccuggacccuggaggauaaggagcagaucacggaggcccgcaagaucguggccgaguccaagcccuggaagaccuucaaggaggaccugaagaagaucgaggaggggauccucgugagccacuacacccccgacaacgucaagaagcaguccaagaagaucgugcgggugcgcggccggaagcaguacgucgccgagauagagcgcgacgugaacggcaaggccguggccaagaaggacauuagcgggaaggucaucuacaagcuggacaaggacggcaagaagcugccgcggcuccaacagggggacaccauccgcggcucccugcaccaggacagcaucuacggcgccaucaagaacccccugaagacggaggagauccgguacgugauccgcaaggaccucgaguccaucaaggcgagcgacguugacaacaucgucgacgagaugguaaaggagaagguuaaggaggccaucgccuccaagguccugauccugagcuccaacccccagcagaagaacaagaucgacggcaagguguggaugaacgaggagaagggcauccccaucaacaaggugcggcucuacgccaacagcgucaagaacccgcuggagaucaaggagcacuccagucugagcaagucccgccaugagcacaagcagaagguguacgggcagaacgacgagaacuucgccauggcgaucuacgagggccucgacaaaaaggggaagacggagcgggcuuucgagcuuaucaacuacauggacgccggcuacuacuacaagcugaagaacaagaacgagcgcaagaaggacaucaucagccucgugcccgagaagcauaucgaaaccggguuuaaccugcugcgcuccaacaagauccccaucauccucaagaagggccugaacgucauccuguacaagaacgagaaggaggagaucgacuucaacaacccgaacagcaucaucaagcggcucuacaagaucuccggccuggacaaggacgggaucaagcugauguacugcaucagcgccaagggcuccaccgagaacaucgccuacaugaacgacgugaucaacaagcagaaguuauucgagcucaagagcgagauggagaagcugggacugugggacaagguguucuccgacuucaaaaacgacaacuuaaagaaguccgacuucuucaagaagcugaaugaccuccugaacaagcacuacuucgagaacaacgucugcgacagcaucggcagcaucaagaaggugaagaucaaggaguccgggcugacgacccccaagggcggggacgugaucgacaacuucaaggacuuccccuacauuaaguucaaggucagcaacuucaacgcgcucaucgaggggaucgacuucaagaucucccccaccggcaaguucgugcagaucuga

SEQ ID NO: 8083 - RNA, 4587 nt, Artificial Sequence
  Cas9 variant
augaagaagauccugggccucgaccuggggaccaauagcaucggcugggcccugguggagcaggacuucaagaacaagcagggcaacaucauggggauggggucccgcgucauucccaugagccaggagauccucggcgaguucgcccgcggcaacaccaaguccgagaccgcggaacgcaccaggcugcgcagcgugcgacgccugcgggagcgccaccuccugcggcgcgagcggcugcaccgcgugcuccacaucuugggguuccugccgaagcacuacgucaaccagaucgauuuccaggagcgucucggcaaguucuucgaggaauccgagcccaagcuggccuacgacaccggggacuuccuguucaagcccagcuuccucgagaugcuggaagaguucaagauccaccaacccuccuucguugagggcgacaagaaggugccguacgacuggaccaucuacuuccugcgcaagaaggcccucacggaacggaucgagaaggaggagcuggccugggucauccugagcuuuaaccagaagcgcgguuacuaccagcuccggggcgaggacgaggaggagaagcccaacaagcuggaggaguucuacucccugaagaucgucgacaucaagguggacgagagccccaacaagaagggcgacaccugguauagucucacccucgagaacgguuggaucuaccgccggagcuccaaggucccccuggacgacuggcucggaaaaacccgcgacuucauagucacgaccgacaucgacgaggaggggaacccgaagcuggacaaggagggaaaccccaagcggagcuucagggcgcccuccgaggacgacugggggcugcgcaagaagaagaccgagaaggagauccucgacagcuccaagacgguggggcacuucauuuucgagaaccugcucgcggaccccacgcagaagaucaagggccggcucgucaggaccaucgagcggaaguucuacaaggacgagcugaagcaaaucuuagugagccagaaccgcuuccacccggaacucagugaugcagacaugauggccgacugcgugcgggagcuguacaagcacaaccacagccaccagaacuuccuggccagcaaagacaucaagcaucuccuggucgacgacaucaucuuuuaccagcgccccuuaagaucccagaaguccaccaucgggaauugcccccucgaguucaaaaccuucaagaaggacggcaucgagaucaaggugcccuacaagguggcgcccaagagccacccgcuguuccaggaguuccgccugcuccagugggucagcagucugcggaucauccgcaagagcgacgacuccgacgugacgcgggaguuccuggggacacaggacaagaccaagcagcuccuggacuaccucaugacccagagcgagauggacugcaauaagcugaugacguuccuccugacccaggagggcuacaagcgcaaggaccugaaguccgaggugggcaaguuccgguggaacuaugucuucgacagcgagaccggggaguccaagaccuaccccggcaacagcacgcgcgccgaguuccucaagcggcuggggaagguggaaggcuucgacuucuccaaguacaccgaggaguucgaggagagccuguggcaccucguguacucggucacugacaagguggaguucgaaaaggcccugaggaaguucagccggaagaacgggaucgagaucaacuccuucgucgaaaaccugaagaaguucccgcccuacaagagcgaguacgccuccuacagccucaaggcuaucaaaaagcugcucgcgcucaugcgauucggcgagaacuggaaggaggacagcaucgacuccaucagcaagcacagaaucgagaagauccugaccggcgaguacgaccccgagaucaaggacaaggugcgugagaucucccgcgccuucgacgagguggaggacuuccaggggcuccccgucugguuugccaacuacgugguauacggccggcauucugaggcaucagagcucaucaaguggacgagcuccgaugagauggccgacuuuaucaaggaguucaagcagcacagccugcgcaaucccaucgucgaacaggucgugcuggagacccucaggguggucaaggacaucugggacaaguacgggcacggccagaaggacuucuucgacgaaauccacguggagcuggggcgcgagcugaaaaacccggcggagcagcgggcccgccucacaacccagaucuccgccaacgagaacacgaaccugcguauaaagagccugcucgucgagcugcugcacgaccccggcguggagaauguacgccccuacagcccaaugcagcaggagauccuaaagaucuacgaggagggcguccucaagagcucguuugaggugccggacgacauccugaagaucucgaagaccgcccagcccuccagcucggaccugaagcgguacaaacuuuggcuagagcagaaguaccgcagccccuacacugggaagaucaucccgcucaacaagcuguucacccccgccuacgagguugagcacgucaucccccagagccgguacuucgacgacuccuuuagcaacaaggugaucugcgaggcggccgugaacaagcugaaggacaacagacucggcauggaguucaucaagugcuuccacgggcagcgggucucccuaggcuucggcgaagaaguggagaucuucagcgaguccgccuacaaggcauucauccaggacaacuucccgaagaacccggcaaagaagagaaaauugcucauggacgagcuacccgagcagaugguggagcggcagaugaacgacacgcgcuacaucagcaaguucgucaccuccauccugucgaacauugugcgguccgaggagaacgacaccggguucaacagcaagaacaucauccccggcaacggaaagaucaccaccgcgcucaagcaggacuggggucugaacgacguguggaacgagcuuauccucccccgcuucgagcggaugaaccagcugacggggaccaccgucuucaccgccuggaaugagaaccaccagaaguuccugccgacggugccccucgaguacgccaagggauuccagaagaagcgcaucgaccaccggcaccacgccauggacgcgcuggugaucgccugcgccacccgcgaccacgucaauuaccugaauaacgagcacgcccucggcaagaauuauaaggggaaggaggagaagcaguccaggcgguuugacuugcgccagaagcugugccucaagaagaagaacggccacagccaggagcaguacgaguggaucuucuccaagccgugggacagcuucacccaggaugccaaaaagaaccuggagcggaucaucguguccuuuaagcaaaaucugcgcgugaucaacaagaccagcaacaaguacuuauccuacaaggaugaggaggggaaccuucgccuggacagccagggcaagccagucaaggcgcucacgcgccagaucaagggugacgccugggccaucaggaaguccauccacaaggacaccgugagcggccuggugaagcugcgccgggucaagauggugaaccucagcguggcccuggacaacccugagaacauccugaacaagaagcucaagaagaagaucgcggagcugguuaagcugaacuacgacaauaagcuccugcugaaguacuuccgcgaccgggacuacauguucgacggccgcgagguguccaagcucgacguguacuacuucgaggagggccuggcggccucgagagucucccuggacaccagcuucuccgacaagaagauccagagcaucaccgacacgggcaucagaaaaauccuccuggcccaucuggccaacuaccacgggcggcucgacgagaagggcaaggugaucccgcccgagacgcuggccuucacccccgaggggaucgaggaguugaacaagaacaucaagggccucaacggcgggaaguuccaccagcccaucuucaaggugcgcaccuacgagcccaaagguaacaaguuccaggucggguucaagggaaauaagaacuccaaguacguggaggcggccaaggggacgaaccuguucuucgccaucuaccugaacgacgagggcaagcggagcuacgagaccauccccuucaacguggucauggagcgacuaaagcagggcgaggggcccgugccccaaaccaacgagaagggcgggaagcugcuguuccaccucucuccaaacgagcugguguacguccccgagaccgacgagaacuacacgaauguggacuucaagaaccugagcaaggagcaggucgagaagaucuacaagaugguuuccuccaccggcagcgagugccacuucgugagagccgacaucagcuccuugaucaagggguacgacgcgaagacaaaggucggcgagcuagggagccugaacaagcaggaggugaccaacaacgguaugacucgcaucaaagagaagugcuggaagauaaagaucgaccgccucggcaguaucuga

SEQ ID NO: 8084 - RNA, 4587 nt, Artificial Sequence
  Cas9 variant
augaagaagauccugggcaucgaccucgggaccaacagcaucggcugggccguggucaacuccuucgacgagaaccagaacgaggagagccugaagcacaucgagugcguggggucccgcaucauccccauggacgcagcgauccugggcgacuucgacaaggggaacagcaucucccagaccgccaagcggacggaguuccgcagcgugcggcaccuccgcgagcggcaccuccugcgccgggcccgccuccacaagauccugucgcugcucggcuuccugccggaccacuacguccaggaccuggacagccacggcaacuuccccgugaacguggaaccuaagaucgccuggcggaaggacuccaacggggccuucgaguucaucuuuaacgacagcuucgacgagaugcuccaggacuucgcgaccuaccagcccgagcugaucgccugcaacaagaaagucccguacgacuggaccaucuacuaccugcgcaagaaggcccucaccaagaagcuguccaaggaggagcugagcuggauccuccugaacuucaaccagaagcggggcuacuaccagcugcgcggggaggaggacgacgagucugucaagagcgccaagacgcggcaguacuucgaccgccagaagaucaaguccaucguggacaccaaucagacauacaagggccagaaggugcucaucguggagcucgaggacgggaucaagggcaagauuuucaagaaggagauccccaacugggugggccaggaaaaguccaucaucgucaccaucgacaucgacaaggacgggugcgauaaguacgaggagagcggcgagcugagcugccgguucaagauccccuccgacgcggagugggagagcgaguggaagcucaucaagaugaagacgcagaaggaccuggacgccagcgggaagaccgugggcgccuacauuuacgacgccauccugcagaaccccucccagaagauccgcggcaagcucgugcggaccaucgagcgcaaguacuacaaggaggagcugaagcagauccugaagaagcaggucgaguuccacccggagcuccgggacaaggaccuguuccuggacugccucaacgagcuguaccccaacaacgacgcccaccgcaacgcgugugccgaccgggacuucaucuaccuguucauggacgacauccuguuuuaccagcgcccccucaagagcaagaagucccugaucgccgacugccccuacgagaagcacauguaccgcgacaaggagaccggggagcucaaguacagcuccgugaagugcaucgccaagagccacccgcuguuccaggaguucagacuguggcacuucaucuccaacauccgcaucuaccagaaggagcgggugguugacguggacgcggaccagagcgcgcucuccagcgcccgauccgcccucaagagcaagcuagaggccgauguggacgucacgaacgaguuccugaccugcgaggccgacuacgugucccuguucgaguggcugaauaacaagaaauccgugagccagaaggacuuucugaaguaccccgcguucggcaucaagaaguccggggacaacuaccgguggaacuacgucgaggacaagagcuaccccugcaaugagacccgcgccuuaauccugagccaccuggagaaggccaacauccggggcgauaucuucacccgcgagcaggaggaggcccucuggcacauccuguacuccguggaggaccgguacgagaucgucaaggcccugcagagcuucgcggccaaguaccgcuucaacgacgacuucgugacgguguucucuaaguucccgcccuucaagaaggaguacggguccuacagcgccaaggccaucaagaaguugcugccccugaugcggaugggcaaguacugguccgaggcggccaucgacauuaagacccgcgagcggaucgagaagaucaucaccggcgagugcgacgacagcauccgcgagcggguccgccucaaggccauccggcugcacgacaucggggacuuccgcgcccugcccguguggcucgccugcuacguggucuacgaccgccacucagagagcggcgacaucaccaaguggaagacgccccaggagauggacugguacauccagaacuucaaacagcacuccuuacgcaacccgaucguggagcaagucaucaccgagacccugcgcgugguacgugacaucuggaagcagguagggcgcaucgacgagauccacguggagcucggccgggagaugaaaaaccccgcggacaaacgcgccaagaugaccgcccggaugaucgagaacgagaacacgaaccugcgcaucaaggccaugcugaccgaguuccuaaacccugaguucgagaucgagaacgugcggcccuacagcgccucccagcaggauauccugcgcaucuacgaaaacggggugcugaacagcgucuccgagaucccggaggagaucaccggcauccucaagaaguucaacgagcgcgagcagcgcaaacggcccagcaccuccgaagugcugcgcuacaagcucuggcucgagcagaaguacaggagccccuacacgggcaagaugaucccccuggggaaacucuucaccccggcguacgagaucgagcacaucaucccccagucccgcuacuucgacgacagcuucaacaacaaggugaucugcgaggccgaggugaacaagcucaagggcaaccugcugggguacgaguucauuaagaagcaccacggccggcgcguggaccucgggcugggcgagaucguggacauauucuccgucgacgaguacgagaccuucgugaaggacuacuacagcgccaaccagcagaagaugaagaagcugcucauggacgagauccccgagcaguucaucgagcggcagcugaacgacagccgcuacaucuccaagguggucaagagccugcucaguaacauagugcgggagcaggacgagcaggagagcauuuccaagaaucugaucgugugcaccggcggggucacggaccguuugaagaaggacuggggcaucaacgacguguggaacaagcucauccuaccgcgguuccagcgcuugaacaacaucaccgagaccaccgaguucacggccaagaacaugcaggggcacgagauccccgugguccccuucgaguaccagcgcggcuucaacaagaagcggaucgaccaccgccaccacgccauggacgcgaucgugaucgccugcgcgggccggaacaucgucaacuaccucaacaacgagagcgcccgcaagaaggcgcagauuucccgguacgacuuacagcgccugcucugcgauaaggucaagaccgacgacaacgggaacuacaaguggauccugaagaagcccuggagcacccugacgcaggacguguacgccgcccucgacaacgugaucguauccuucaagcagaaccugcgggugaucaacaagaccaacaaccacuacguccacuacgaggcaggcaagaagaucauagccaagcaggagaaggcgagcugggccauccgcaagccgaugcacaaggacacggucuucggcgaggugaaccugcggaaggugaaaaccgucucccucaacgaggccaucaagagcccccacugcaucgugcagaaagacuucaagaagaagcugcugucccuccucaagcagaacuucgacgccaaggaggugaaggccuacuucgaggagcacaaggacgucuggagcgacaucaaccugagcaagaucgagguguacuacuucaccaaggacaccaaggagcgcuucuucgcgacgcggaagccccucgacagcuccuucgaccgcaagaagaucgagagcgugaccgacaccggcauccagaagauccuucugcggcaccucgaacagaagaauggggacuccgaccuggccuucagccccgacggcaucgaggagaugaaccagaacaucguccagcugaacggcgggcgcaagcaccaaccgaucgugaaggugcgggucuacgagaaggccgacaaguucgccaucggccagcagggcaacaaggccagcaaguacguggaggcggccaagggcacaaaccucuucuucgccgucuacgaggaggaggugcgggacaagaagacgaacgccgugauguucaagcggaacuacgcguccaucccccugaacgucgccaucgaccgccagaagaaggggcuguccacugcccccgaggacgagaauggcaaugcccccaucuucgugcucuccccgaacgaccugguguaccugcccaccgccgaggacaucaucaacgcgcggaucagcuuccccaucaacaagaaccgcaucuacaagauggucuccugcaccggcuaccagugcuucuucaucaagcaccacguggccaacgugaucguggacaagaaggaguucagcgcccucaacaagauggagaaggccgagacgaacgagaugaucaaggacaucugcgugcccaucaagcuggaccgccuggggaacaucgugaaaaucggggucuacaaguga

SEQ ID NO: 8085 - RNA, 4587 nt, Artificial Sequence
  Cas9 variant
augaagaagauccugggccucgaccuggggaccaauucgauaggaugggccgugguaaacuccuucgacgagaaccaaaacgaggagagccugaagcacaucgagugcguggggucccgcaucauccccauggaugcagcgauccucggcgacuucgacaaggggaacagcaucucccagaccgccaagcggacggaguuccgcucugugcggcaccuccgcgagcgucaccuccugaggcgagcccgccugcacaagauccugucccuccugggcuuccugccggaccacuacguccaggacuuggacagccacggcaacuucccagugaacguggagcccaagaucgccuggcggaaggacuccaacggggccuucgaguucaucuucaacgacagcuucgacgagaugcugcaggacuucgcaaccuaccagcccgagcugaucgccugcaacaagaaggucccguacgacuggacuaucuacuaccuccgcaagaaggcccuuaccaagaaacuguccaaggaggagcucaguuggauucugcugaauuucaaccagaagcggggcuacuaccagcuccgcggggaggaggacgacgaauccgucaagagcgccaagacgcggcaguacuucgaccgccagaagaucaaguccaucguggacaccaaccagaccuacaagggccagaaggugcugauaguggagcucgaggaugggaucaaagggaagauauucaagaaggagauccccaacugggugggccaagagaaguccaucaucgucaccaucgacaucgacaaggaugggugcgacaaguaugaggaguccggcgaacucagcuguagguucaagauucccuccgacgcggagugggagagcgaguggaagcugaucaagaugaagacgcagaaggaccuggacgcgagcgggaagaccgugggcgccuacaucuacgacgccauccuacagaaccccucccagaagauccgcggaaagcuggugcggacuaucgagcgcaaguacuacaaggaggagcucaaacagauccucaagaagcaggucgaguuccacccggagcugcgggauaaggaccuguuccucgauugccugaacgagcuguaccccaacaaugacgcgcaccgcaacgcgugcgccgaccgggacuucaucuaccucuucauggacgacauccuguucuaccagcgcccccucaagagcaagaagucccugaucgcagacugccccuacgagaagcacauguaccgcgacaaggagaccggggagcugaaguacagcuccgugaagugcaucgccaagagccacccgcuguuccaggaguuccggcucuggcacuucaucuccaacauccgcaucuaccagaaggagagaguggucgacguggacgccugccagcccgaccucagcuccgcgcgcagcgcacugaaguccaagcuggaggccgauguagacgucacgaacgaguuccugaccugcgaggccgauuacgugagccuguucgaguggcuaaacaacaagaaguccgucagccagaaggacuuccugaaguauccagccuucggcaucaagaaguccggcgacaacuacagauggaacuacgucgaggacaagagcuaccccugcaacgagacccgcgcccugauccugucccaccucgagaaagccaacauccggggcgacaucuucacccgcgagcaggaagaggcccuguggcacauccuguacaguguggaggaccgguacgagaucguuaaggcucuccaauccuucgccgcgaaguaccgcuucaacgacgacuucgugacgguguucagcaaguucccgcccuucaagaaggaguacgggagcuacucugccaaggccaucaagaagcugcugccucucaugcggaugggcaaguacuggagcgaggccgcgaucgacaucaagacccgcgagcggaucgagaagaucaucaccggugagugcgacgacuccauccgcgagcggguccgccugaaggccaucagacugcacgacaucggggacuuccgcgcucucccuguguggcuggccugcuacguggucuacgaucggcacagcgaguccggcgacaucacaaaguggaagacgccccaggagauggacugguacauccagaacuucaaacagcacagccugcgcaaccccaucguggaacaggucaucaccgagacccuccgcguggugcgugacaucuggaagcaggucgggcgcaucgacgagauccauguugagcugggccgggagaugaagaaccccgccgacaagcgagcgaagaugaccgcccggaugaucgagaacgagaacacuaaccugcgcaucaaggccaugcucaccgaguucuuaaacccagaguucaagaucgagaacgucagaccuuacuccgcgucucagcaggacauccugaggaucuaugagaacggggugcucaacuccgucagcgagauccccgaagagaucaccggcauccugaagaaguucaacgagcgggagcaacgcaagcggcccuccaccagcgaggugcugcgcuacaagcucuggcuggagcagaaauaccggucccccuauacgggcaagaugaucccgcuggggaaacuguucacccccgccuacgagaucgagcacaucaucccccagaguagguacuucgacgacuccuucaacaacaaggugaucugcgaggcggaggucaacaagcugaagggcaaccugcucggguacgaguuuaucaagaagcaccacggccggcgcguggaccuggggcugggcgagaucguggacauauucagcgucgacgaguacgaaaccuucgugaaggacuacuacuccgccaaccagcagaagaugaagaagcuccugauggaugagaucccggagcaguucaucgagcggcagcugaacgacagccgcuauaucagcaagguggucaagucccuccugagcaacaucgugcgggagcaggaugagcaggaguccaucagcaagaaccuuaucgugugcaccggcggcgucacggaccgccucaagaaggacuggggcaucaacgacguguggaacaagcugauccugccccgguuccagcgcuuaaacaacaucaccgagaccaccgaguucacggccaagaacaugcaggggcacgagauccccgugguccccuucgaguaucagcgcggcuucaacaagaagagaauugaccaccgccaccacgccauggacgccaucgugaucgccugcgccggccggaacaucguuaacuaccugaacaacgaguccgcccgcaagaaggcccagaucagccgguacgaccugcagcgacuccugugcgacaaggucaaaaccgacgacaacgggaacuacaaauggauccugaagaaaccgugguccacccucacgcaggacguguacgcggcccuggacaacgucaucguuagcuucaaacagaaccugagggugaucaacaagaccaacaaccacuacgugcacuacgaggccggcaagaagaucaucgccaaacaggagaaggcgucaugggcgauccgcaagcccaugcacaaggacacggucuucggggaggugaaccucagaaaggugaagaccgucagucugaacgaggccaucaagagcccccacugcaucgugcagaaggauuucaagaagaagcugcucagccugcugaagcagaacuucgaugccaaagaggugaaggccuacuucgaggagcauaaggacguuugguccgacaucaaccucagcaagaucgaaguguacuacuucaccaaagacaccaaggagcgcuucuucgcuacgcggaagcccuuggacuccagcuucgaccgcaagaagauagaguccgugaccgacaccggaauccagaagauucuccuccggcaccuggagcagaagaacggugacagcgaucuggcuuucuccccggacggcaucgaggagaugaaucagaacaucguccagcugaacggcgggcgcaagcaccaacccaucgugaagguacgggucuacgaaaaggccgacaaguucgccauaggccagcaggggaacaaggccagcaaguacguggaggccgcgaagggcaccaaucuguucuucgccgucuacgaggaggaggugcgcgacaagaagacgaaugccgugauguucaagaggaacuacgccagcaucccccuaaacgucgcgauugaccgccagaagaaggggcucuccaccgcccccgaggacgagaacggcaacgccccgaucuucgugcugagccccaacgaccugguuuaccuccccaccgccgaggacauuaucaacgcccggaucuccuuccccaucaacaagaaccgcauauacaagauggucagcugcaccggauaccagugcuucuucaucaagcaccacguggcaaacgugaucguggacaagaaggaguucuccgcccugaacaagauggagaaggccgagacgaacgagaugaucaaggacaucugcguuccgaucaaacuugaccgccucgggaacaucgugaagauuggcgucuacaaguga

SEQ ID NO: 8086 - RNA, 4590 nt, Artificial Sequence
  Cas9 variant
augaagaagauccugggccucgaccuggggaccaacagcaucggcugggccguggucaacuccuucgacgagaaccagaacgaggagagccugaagcacaucgagugcuuagggucccgcaucauccccauggacgccgcgauccugggcgacuuugacaaagggaacagcaucucccagacagccaagcggacggaguuccgcggcgugcggcaccuccgcgagcggcaccuccugcgccgggcacgccugcacaagauccuccggcugcuggguuuccucccggaucacuacgugcaggaucuggacgggcacggcaacuuccuggucaacguggagcccaagaucgccuggcgcaaggacagcaacgggaccuucgaguucaucuucaacgacuccuucgacgagaugcuccaggacuucgccaccuaccagcccgagcucaucgcguguaaccggaagguccccuacgacuggaccauuuacuaccugcgcaagaaggcacucacgaagaaacuuagcaaggaggagcuguccuggauucuccugaacuucaaccagaagcggggcuacuaccagcugcgcggggaggaggacgacgagagcgucaagaccgccaagacccggcaguacuucgaccgccagaagaucaaguccaucguggacaccaaccaaacguacaagggccagaaggugcucaucgucgagcuggaggacggcgugaaggggaagaucuucaagaaggagaucccgaacugggugggccaggagaagucaaucaucgucaccguggacaucgacaaggacgggugcgacaaguacgaggagagcggcgagcugagcugccgguucaagauccccuccgacgccgagugggagagcgaguggaagcucaucaagaugaagacucagaaggacuuggacgcguccggaaagaccgugggggccuacaucuacgacgccaucuugcagaaccccagccagaagauccgcggcaagcucguccggacgaucgagcgcaaguacuacaaggaggagcugaagcagauccugaagaagcaggucgaguuccaccccgagcuccgggacaaggaccuguuccuggacugccucaacgagcuguacccgaacaacgacgcccaccguaacgccugcgcggaccgcgauuucaucuaccuguucauggacgacauccucuucuaccagcggccccugaaguccaagaagucccugaucgccgacugccccuacgagaagcacauguaccgcgacaaggagaccggggagcucaaguacagcagcgugaagugcaucgccaagagccacccccuguuccaagaguuccggcuguggcacuucaucuccaacauccgcaucuaccagaaggagcgggugaucgacguggacgccugccaaccggaccucagcuccgcccgcagcgcgcugaaauccaagcuggaggccgacguggacgucaccaacgaguuccugaccugcgaggccgacuacgugagccuguucgaguggcugaacaacaagaaguccgugagucagaaggacuuccugaaguaccccgccuucggcauuaagaaguccggggacaacuaccgguggaacuacgucgaggacaagagcuaccccugcaacgagacgcgcgcccucauccugucccacuuggagaaggcgaacauccggggcgacaucuucacccgcgagcaggaggaggcccucuggcacaucuuauacagcguggaggaccgguacgagaucgucaaggcccugcaguccuuugccgccaaguaccgcuucaacgacgacuucgugaccguguucagcaaguucccgcccuucaagaaggaguacggcuccuacagcgcgaaggccaucaagaagcuccugccccugaugcggauggguaaguacugguccgagagcgccaucgacaucaagacccgcgagcggaucgagaagauaaucacgggagagugcgacgacagcauccgcgagcggguccgccucaaagccauccggcugcacgacauagagcacuuccgcgcgcugcccguguggcucgccugcuacguggucuacgacaggcauuccgagagcggggacaucaugaaguggaagacgccacaggagauggacuccuacauccagaacuucaagcagcacagccugcggaacccgaucguggagcaggucaucaccgagacccugcgcguggugcgggacaucuggaagcaggucggccgcauagacgagauccacguggagcucgggcgggagaugaagaaccccgccgacaagcgcaaggaaaugaccaagcggaucaucgagaacgagaacaccaaccugcgcaucaaggccaugcugaccgaguuccucaaccccgaguucgagaucgagaacguacggcccuacuccgccucucagcaggacauccugcgcaucuacgagaacggagugcugaacuccgucagcgagaucccggaggagaucaccggcauccucaagaaguucaacgagcgggagcagcgcaagcggcccuccacgagcgaggugcugcgcuacaagcuguggcucgagcagaaguacugcucccccuacaccgggaagaugaucccccugggcaagcuguucacccccgcguacgagaucgagcacgugaucccccagagccgguacuucgacgacuccuucaacaacaaggucaucugcgaggccgaggugaacaagcucaaggggaaccugcugggcuacgaguucaucaagaagcaccacgggcagagaguggaccucggccugggcgagaucgucgacaucuucagcguggacgaguacgagaccuucgugaaggacuacuacuccgggaaccagcaaaagaugaagaagcugcucauggacgagauccccgagcaguucaucgaacggcagcugaacgacagccgcuacaucuccaaggucgucaagagccugcucagcaauaucgugcgggagcaggacgagcaggagucgaucagcaagaacgugaucgugugcacaggcggggugaccgaccgccugaagaaggauuggggcauuaacgacgucuggaacaagcugauccucccgcgguuccagcgccugaacaacauaaccgagaccacggaguucaccgccaagaacauggaaggccacgagauccccguggugcccuucgaguaccagcgcggguucaacaagaagcggaucgaccaccgccaccacgccauggacgccaucgucaucgcgugugccucccggaacaucgugaacuaccugaacaacgagagcgcccgcaagaaggcccggaucucccgcuacgaccuccagaagcugcugugcgacaaggugcggacggacgacaacggcaacuacaaguggauccucaagaagcccugggggacccugacccaggacgucuacgccgcucuggacaacgugaucgugagcuucaagcagaaccuccgcgucaucaacaagacgaagaacuacuacgugcacuacgaggccgggaagaagaccaucgccaagcaggagaagggguccagcugggccauccggaagccgaugcacaaggacaccguguucggcgaggucaaccugcgcaaggucaagaccgugucucugaacgaggcgaucaagaacccccagugcaucgucgagaaggacuucaagaagaagcuccugagccugcucaagcagaacuucgacgccaagaaggugaaggccuacuucgaggagcacaaggacgugugguccgacaucaaccugagcaagaucgaggucuacuacuucacgaaagacacuaaggaacgguucuucgccacccgcaagccccuggacuccagcuucgacaagaaggagaucgaguccgugaccgacacgggcauccagaagauccuccugcggcaccuggagcagaagaacggggaccccgacuuggccuuuagcccggacggcauagaggagaugaaccacaacaucgugcagcuuaacgggggccgcaagcaccagcccaucgucaaggugcgggucuacgagaaggcggacaaguucgccaucgggcagcagggcaacaaguccagcaaguacguggaggccgcuaagggcaccaaccuguucuucgccguguacgaggaggaggucagagacaagaagaccaacgcggugaugcucaagcggcacuacgccuccaucccccugaauguggccaucgaccgccagaagaaggggcugagcaccgcccccgaggacgagaauggcaacguaccgaucuucgugcucagccccaacgaccugguguaccugcccacggccgaggacaucgcgaacgccagcaucucauuccccaucaacaagaaccggaucuacaagaugguauccugcaccgggaaccgcugcuucuucauuaaacaccacguggccaacgugaucgucgacaagagcgaguucuccgugcucaacaagaucgagaaggcugagaccgacgagaugaucaaggagaucugcgugccgaucaagaucgaccgccugggcaacaucgucaagaucgggguguacaaguga

SEQ ID NO: 8087 - RNA, 4608 nt, Artificial Sequence; identical to SEQ ID NO: 2287
  Cas9 variant

SEQ ID NO: 8088 - RNA, 4608 nt, Artificial Sequence; identical to SEQ ID NO: 2288
  Cas9 variant

SEQ ID NO: 8089 - RNA, 4614 nt, Artificial Sequence
  Cas9 variant
augaagaagauccugggacucgaucuggggaccaacagcaucggcugggcccugaccacgaacgacuucgacaccaagaaggggaccaucgagggccuagggucccgcaucauccccaugagccaggacauccugggcaaguucgacuccggcgugagccugucacagaccgcccagagaacggaguaccgcgggaagcggcgccucguccagcgguuccuacugcgccgggagcgccuccaccgggugcugcacauucuggagcuccugccgaagcaguacagcgaggcgaucgauuucgacaagaagcugggccaguucaagcccgagcgcgagcagaagaucuccuucuacaagaacgagagcgggaagaaccaguucaucuucaccaagucccaccaagagaugcucaccgaguuccagaccuacuaccccaccaucaagaacauccccuacgacuggaccaucuacuaccugcggaagaaggcccugaccgagaagaucagcaaggaggagcucgccuggauccugcugaacuucaaucaaaagcgcggcuacuaccaguugcgcggggaggagaaggaggagaacaagaacaagaaggaggaguuccacacccuacuggugacggauauaaucgagcgggacaagggcaaguccggcaccugguacaacgucauccucgagaacggguggauuuacaagcgggagagcaaaaucucccuggccgauuggaucggcaagaccaagucauucaucgugaccacggaguacaacgacgacggguccgugaagcugaccaaggacaacgaggagaagcgcagcuuccgguccccgaaggaggacgauuggggccucaucaagauccgcaccgagaagaccaucaaccagagcgacaaguccgucggcgccuacaucuacgacgcgcugcugaagaaccccaaccagaagaucaagggggagcucgugcggacgaucgagcgcaaguacuacaaggacgagcugcgggagauccugaagaaacagcucgaguuccacucggacgugcugaacgacaagauccuguacaagaagugcaucgacgaacucuacaaaaacaacgacagccacaagaacuccaucaaggaccgcgguuucgacuacuuguuccuggacgacauaaucuucuaccagcgaccccucaagagcaagaccucccugaucagcgacugcucccuggaguuccggcccaucaagaacaagaacgggguccucgugaaggacaccgacggcaagcagaucgccaaggccuugaagugcauagcccgcagcaacccgaucuuccaggaguuccggcugcuccaguucgugaagaaccugaagaucuacaagcgcggggucguggacgacguagaggucaccaacgacuaccugaaguccgagaacgacguggagaagcuguucaacuggcucaacgacaaggcggagaucaaccagaagcaguuccuggugaacuucaagcugaaggaggacaagcaccgguggaacuucgucgaggacaagggcuaccccugcaacgagacgcgcaaccaguuccuaaacgccaucgccaagaucgacguggacaagaguuucuucaacaccaagaacacccaggaccuguggcacauccuguacagugugaccgacaagaucgagaucacgaaggccaucaccaccuucgccaagcggcacaaccuccccaacgaguucaucaucaacuucagcaagaucaagcccuacaagaaggaguacggcuccuucuccgagaaggcgaucaagaagcugcugccccucaugcgcuucggauccuacugggacgccaagaacaucgacaucaagacucuggaccggaucgacaagauccagacgggcgaguucgacgagaagauccgcaaccggguccgcgagaaggccaucgaccugcacaagaucgacgacuucaaggaccucccccuguggcuagccagcuacaucguguacgacaagcacucagaggccagcgacguguccaaguggaagacccccgcggacaucgagaaguuccucaaacacgaguucaagcaacacagccugcggaaccccaucgucgagcaggucauaaccgagacccugcgcguggugaaggacaucuggcuccaguacggggagggcaaggagaacuucuucaacgagauccacaucgagcuggggcgggagaugaagaacgacaaggccacccgggagaagaucuccaagaaggucagcgagaacgagaacaccaaccugcggaucaaggccauccucaccgagcugaagaacgacggcgucucggacauccgcccguacucccccagccagcaggagauucugaagaucuacgaggagggcguguacaacaaugagucccggaaggagaagcucgaggagguggacaagauccgcaagaacgccaagcccaccaccagcgagaucaucaaguauaagcuguggcuggagcagggguacgccucccccuacacgggcaagcucauaccgaugagcgagcuguucacaaccaaguaccagaucgagcacaucaucccccagucgcgcuucuucgacgacagccuguccaacaaggucaucugcgagucggaggugaacgagcucaaguccaacaugaccgcgcuggaguuuauccugacgaacgagaaccggaucgugacccucaccgggggcgagaccgucaagaucuucacgaaggaggccuacaaccagcacaucaucucguacuacuccaagaacaagaacaagcagaagcgccugcugaccgaggagauccccgagcaguuuaucagccggcagcucaacgacacgaaguacaucuccaagaucgugaagaaccugcugagcaagaucgugcgugaggaggacgagcaggaggucaccuccaagcacguggugucgcucaacgggagcaucacgucccggaugaagcaagacuggggccugaacgacgucuggaacaccaucgugagcccccgcuucgagcggcugaacacccucaccaacuccaacgacuucggccaguucgagcugaaaaaggacgccuacgggaacgagggcaagcgcguguuccagacgaccgucccggacgccaucgccaagggguucaccaagaagcggaucgaccaccgccaccacgcgcuggacgcacuugugaucgccugcgugaaccggacccacaucaacuaccugaacaaucugaacgccaaagacacggacgacaaggcggucaagcacgagcuccgcaacaagcugugcuucaagaccaagcccgacagcaacggcaacuacaagugggaguuccacaagcccugggagaaguucacgaaggaggcccaggacaagcugaacacaacgaucguguccuucaagcagaacacccgggugaucaacaagaccgucaacaaguacgugagcuacaaggacgagaacggcaaccucaacguggacgccaacgggcugccccagaagaaggucaucacgcagacgaagggcgauaacugggccauccgcaaaccgcugcacgccgagaccguaucagggaagguguuccucaagcggaucaagcagagccacaucaccaucgcgaacgccaucgaacaggucgagcugaucguggacaaggaggugaagaaacagcugaaggccaagaucaagcucuaccccaacaacaucgccggccugaagaagcaccugaaggccuuccccgucaugaucaacgacaaggcaaucgacaagauccagaucuacgagacccucgaggccacggccacccgcaagauccuugacaucaccuucgacgagaagaagauccagaagaucaccgacacggggauccaaaagauccugcuuaaccaccugaagcaggagaaguaccagaacaccguagacgagaauggcaagaagcuggcuccgcacgagaucgccuucucagagaacggccucgaagaccugaacaagaacaucaccuuccugaacgacgggaagaaccaccagcccaucaagaaggugcggaucuucgaggagggcaacaaguucccccucggggagguuggcaacaagaucaacaaguucguggagaccgcgaaggggaccaaccuguucuucgcaguguacgagaacgacgacaagaaacgcaacuacaagacgauacccuucaacgaggucaucgagcggcagaagcagggccugaacgccgcccucgagaucgacgagaacggcaaccgccugcuguucacucucagcccgaacgaccugguguacaucccccuggaggacgagaucggguaccucaacggcguguacuucaagaaccugaacaaggagcaaacgguccggaucuacaaguucgugagcugcaccgggggcgaggggcauuucgugcccaacaacuacagcaaggagaucaucuccaacgagaacggcagcaacaacaagaacgagcgcaugcugaacuucaacaacuucaacaucaucuucgacggcaaggaaaagcccgucaugaucaaguccaucugcuggaagcucgagguggaccgccuuggcaaggugaucaagaucaucaaguga

SEQ ID NO: 8090 - RNA, 4617 nt, Artificial Sequence
  Cas9 variant
augaagcacauccugggccucgaccuggggaccaacucaaucggcugggccuuggugaaguccgagcaggacugcgacgacgucgagcgcaucaacgggaucgaggccgcgggcagccggaucauccccauggacgccgccgugcucggcgacuucgccaagggcaacaccaagucccagacggccgaccgcaccgcggccagaggcauccgccggaugggggagcgccacaagcugcggcgcgagcggcugaaccgcguacucgacgucaugggcuuccugccggagcacuacagcgccgcccugacccgcuacgggaaguucaaggacggcgaggagugcaagaucgcguggcgcaaagacgagagugggcaguggaccuucguguucgaggacagcuuccgggagaugcucgcugacuucguggcccaccagcccgaguggcuggccggcggccgcaaggucccguacgacuggacuaucuacuaccugcggaagaaggcccucuccaagccccugacaaagcaggagcuggcuuggcuccugcugaacuucaaccagaagcgcggguacuaccagcuccggggcgaggacgagcacacggacgacaaggggaagcugguggaguacuacgcccugaagguggucggcguggaggacaccggcgacaagaaggggaaggacacgugguucaacaucaugcucgagaacggcauggucuaccgccggccggccgccgaggcccccgacuggaucgggaagaccaaggaguucauugucaccaccgaccuggagaaggacggcacgcccaagaaggacaaggaggggaacaucaagcgcagcuuccggaugcccaaggaggacgacuggacccugaucaagaagaagaccgagaacgacaucgaccgcuccggcaagaccgugggcgaguacaucuacgacgcgcuccuggccgacccgacgcagaagauccgcggcaagcuggugcggaccgucgagcgcaaguacuacaaggaggagcucaagaagaucaucaacucccaaaagcgguucauccccgagcugaacgacaacgagcuguacggccgcugcaucuccgagcucuaccagagcaacgacgccuaccggcaguccaucagcuccugcgacuucaccuaccuguucguggacaacaucaucuucuaccagcgcccccucaagagcaagaagucccugaucgacaacugccccuacgaggagcacagcuacaccgacuccaagacgggggaggugaagaccgccccggucaagugcguggcuaagucaaacccccuguuccaggaguuccggcuguggcaguucgugcagaacauccgaaucuucgagcggcagaagaagaucggcgacagcgucaagaccgacguggacgugaccggagaguucaucaaguccgcggacgacgucgugagccucuucgacuucuugaacgaccgcaaggacaucacgcaguccguccugcucgggaccuacuucaaaaucaagaagcccaaaggcaaggacagcgacuaccccuaccgguggaacuauguggaggacaagaccuacccgugcaacgagacccgcgcccugauccugaaggggcucaaggacgccggcaucgacgagggguuccuggacaaggacaaggaguacucccuguggcacauucucuacagcguugaggacaagcaggagaucacgaaggccauggagaaguucgccgcgaagaacucucugggcgguaaguucgccgaggucuucagcucccugccgcccuucaacaagaacuacggcagcuacuccgagaaggccaucaagaagcuccuggcccugaugcggacgggcaaauacuggagcgcggacgccaucgacaaacacacccuggagcgcaucgacaagaucaucaacggagaguacgacgaguccauccggacccgcgugcgggagaaggccaucaaccucacggacgugagccacuuccgcggccugccccugugguuggccugcuauaucgucuacgaccggcacuccgagagcaaggacaucacgugcuggaacugccccgccgacaucgaccaguaccuggaccacuucaagcagcacucccugcgcaaccccaucguggagcaggucgugaccgagacccuccgcaccgugcgggacaucuggcgccaguacgggaagaucgacgagauccacaucgagaugggcagggauaugaagaaccccgcggacgugcgcgccaagaugagcaagcggaugaucgacaacgagaacgccaaccugcgcaucaaggcaaugcuggccgaguucgcggaccccgacuucggcauagccgggguacggccguacucccccagccaacaggagaugcuccgcaucuacgaggagggcgcccuggagagcguggacgaggugcccgacgagaucaacgagaucaucuccaaguucaaccagaccgacaucaagaagcggcccacccauggggaaaucaucaaguacaagcuguggcucgagcagaaguaccagagcccguacacuggccgcaccaucucccuuagccggcuguucacggacgacuaccaaaucgagcacgucaucccccagucccgcuacuucgacgacagcauguccaacaaggugaucugcgaagccgaggugaaccagcucaaggaccggaugcugggauacgaguucaucaaagcccaccauggcgagaagguccugcucagcuccggcgagaccgugaccauccugaccgcggaggaguacgagcgccuggugcagcucaacuuccggaagaaccccgucaagaugaagaagcugcugauggacgacaucccggacaaguuuaucgagcgccagcucaacgacagccgguacaucuccaagaagaucaagagccugcuguccaacauggugcgcgacgagggggagcaggaggacaucagcaagaacgugauugccugcaacggcgccaucacggaccggcucaagcgcgacuggggcgucaaugacguguggaaccacaucauccugccccgguucgagcgccugaacgccgugaccggguccgaccgcuucaccaccacgagcaccaacgggcacaccauccccgacaugccccucaaccugcagaagggcuucaacaagaagcggaucgaccaccgucaccacgcgauggacgccaucgucaucgccugcaccacgagaucccacgugaaccuguugaacaacgaggccgccaugagcaagaacaacgcggugcgcuaccagcugagccggaagcugcgccgguacgaggauaccauggucacccgcaacggcgagacccggacgaucuccguggcccgggaguuccucaagccguggcccaccuucaacgccgacguggagaaagcccugcgggggaucgucgugagcuucaagcagaaccugcgcgugaucaacaagaccgucaacaaguaccagaaguucguguacaacgaggagaagcacaucaaggagaagaaggccgugcggcaggaagaacgcaacggccggcaccuccuggcgauccgcaagcccaugcacaaagacaccgucuacggggaggugaaccuccggaggaucaaggaggugucccucaaggacgccgucgccaaccccaaggccgugguggauaaggaccugaagaagaagcugauggcgaugaucgaacucggcuacgaccugaagcagaucacgaaguacuucgaggacaacaaggaugcguggcaggacgucaaccugaagaagaucaagguguacuacuucaccaaggacaccggggaccgguacuucgccacccgcuucggcaaugaccucgugacgcuguucagcaagaucaccaaggccgacgacgccaagaagcagaucgagcgcaucaccgacaccggcauccagaagauccugaaacggcacuuagaggcgaacgggggcgacugccagaaggccuucuccgccgacgggaucgacgagaugaaccgcaacaucacucagcugaacgggggucggccgcacaagcccgucuacaaggugcgcaucuaugagaaggccgacaaauucgccauaggcaccaagggcaacaaggcggccaaguucguggaggccgcaaaggggaccaaccuguucuucgccgucuaccugaaggaguacgaggacagcaccacgggcgagaccaucaagaagcggguguucgacaccaucccccugaagaccgucaucgaccgccugaaaaacgggcagacucccgcgccggaggagaaggacggcgccaagcucuuguucgugcugucccccaacgaccucguguaccugcccaccgaggacgucgugaagaacggcaccaucaaccggccccuggacaagcgccggaucuacaagauggugagcugcaccgggaccgagugcuacuacaucccguucaucgucgccucccccaucguggacaagguggaguucuucucucucaacaagaucggcagggccaucaccggggaaaugaucaaggagaucugcauccccaucaaggucgaccggcugggcaacaucacagaggugaacaacgagaagaucuga

SEQ ID NO: 8091 - RNA, 4623 nt, Artificial Sequence
  Cas9 variant
augaacaagauccugggccucgaccuggguaccaacagcaucggcugggcccugguggggacggacgaggagggcaacccaauccgcauuuacaaguccgggagcaggaucaucccuaugucacaagacguccucggcaacuuugaccgcggcaacagcaucagccagacggccgagcggaccagcuaccgcggggugcgccgacugagagagcgccacuugcugcgccgggagcgguuacaccgcgugcugcaccucaugggguuccugcccagccacuaugaagaggcaaucgggugggacaagggcgauaacaagaccuucgccaaguucuacagcgacacagagccgaagcugcccuggcggaagaacgcugagcgcgagcaugaguuucucuucaacacgcccuacaacgagauguuaguggacuuccggaagaaccagccccaguuauucaaaaucaagaagaacggucaggagucgcucaucccauacgacuggaccauauacuaccugcgcaagaaggcccugagcaagccgaucucuaaaaaggagcucgccuggaucauucuuaacuucaaccagaagcggggcuacuaccagcugcgcggcgaggaggaggaagaaaacagcaacaagcucaucgaguaccacgcgcuaacaguggugaaggucaucgccgacgagccacagaaggggaaauccgacaucugguacaacgcagagcuggagaacggcuggguguaccggcgcagcucgaaaacgcccuuauucgacugggaguccaaggucaaggaguucguagugaccaccgaccuuaacgccgacgggucccugaagguggacaaggaaggcggcgucaaacggagcuuccgcgugcccuccgaagacgacuggaugcuggugaagaagaagaccgaaagcgacaucgaaaagucagacaagaccgucgggugcuacaucuacgacacgaucuugcagaaccccucgcagaagauccgcgguaagcuggugcgaacgaucgagcguaaguucuacaagaaggagcucacagagauccugaacaagcagaaagaauuucacucggagcugcagaauaaggagcucuaccaggagugcaucaaagaacuguacccucacaacgaagcgcacuacgacucucuguuagucaaggacuacaccgauuuauucgucaacgacaucaucuucuaccagcggccccucaaguccaagaaaucacugauaagcaacugcccauacgaguaccgcguguaucggaacgacuccggcaucguagagcgcguccccaucaagugcauagccaagagccacccgcuguaccaggaguuccggcuguggcaguucauccacaaccuccgcaucuacgaacggcagcgcgaaguuaacggcaagcccgagacagauguggacaucaccgcggaguucauccccaccaccgaggaccgggucaagcuguucgacuggcugaacaacaagaaggaaaucaagcaggacacgcuccugcaguccuauuucaagaucaagaagaagaagggagacgacaaauuccccuaccgcuggaacuacguggaagacaaggaguacccgugcaacgagacccgggcccugauacucaguagauuaaccaagcugaaccugucugaggacuuccucaccaaggagauggagcuggcccuguggcauauccucuacagcgucgaggacaaggaggagaucaagaaggcguucaaguccuucgcccagaaacacaaccuggacgacagcuucguggaccaguucaucaaauucccgcccuucaagaaggauuacggcuccuacagcgccaaggccaucaagaagcugcucccccugaugagaaucggcaaguacugggaugaaaaggccaucuccgggaacacgcgcagccggauccugagcaucaacgagcgccucgaggacaugcguagcagcggcaagaagaucgaggacguguccgacgacgacauccccaagcagguccucaagagcuucgacaaaguuaacggcguguacuccggccugaacaccuaccaggcaugcuacgccgucuacgggcgccacagcgaggccuccgagaucaccaaguggaagacgccccaggacaucgacgacuaccugaacgaguucaagcagcacagccugcgcaaccccaucguggagcaggucaucaccgagacccugcggguggugcgugacaucuggaagaaguacggcgacuucuccgagauccauaucgagcucggaagagagaugaagaaccccgcugauaaacgcgccaaaaugaccacccaaaucagcgagaacgagaacacaaaccugcggaugaaaucucugcucgcggagcugaagaaccacaacgacguggagaacguccgaccguacagccccagccagcaggagauacugaagaucuacgaggagggggugcucaacagcguauccgagaucccggaggaaaucaucaagaucaccaagagcucccagccgagccagacugagcugguacgguacaaacuuuggcucgagcagaaguaccgcucccccuacaccggcgagaucaucccccuagggaaacucuucacguccgccuaugagaucgagcacgugauuccucagucccgguauuucgacgacucucucucgaacaaggugauaugugagucagaagucaacaagcugaagggcaaccugcucggguacgaguucgucaagaaccaccauggcgugaaggucgaacugaacuucaacaagaccguggagaucuucagcaucaacgaguacgaggaguucgugaagggcaacuacgggaagaaccgcggcaagaugaagaagcugcuccuggaggacaucccgaagucuuucaucgagcggcaacugaacgacacccgcuacauaucaaaggucguuaaaggacuccuguccaacaucgugagggaggacggcgagcaggaggccacgagcaagcaugugauucccugcaccggcggggucacgaccauucugaagcaggacugggggcucaacgacguguggaacaagaucgucacgccccgcuuugagaggaugaacgaacugaccaacaccucccuguucgggcagugggagaacaaggagggcaaacgcaucuuccggaccgaggugccccucgagcugcagaagggauucaacaagaagcgcaucgaccaccggcaccacgccauggacgccaucgugaucgcgugcgccaccagaagccacgucaccuaccugaacaacgaguccagcaaggccaacgcuaaggagauuagggacggccucaagcacaagcucugcuucaaguccaaaacggacgagacgggcaacuacaaguggcaguuccacaagccgugggacaccuucacccaggacgugcaggacacgcuggagaacauugugaucagcuucaagcagaaccuccgcgucaucaacaagaccaccaaccgcuaccaaaaguacgaggaagagaagaaaauccugaagucccaggagaagggggacagcugggcgauccggaagccccugcauaaggacaccguauucgcaaagguguccuuacagaagaucaagugcgucaaacuggccauggcccuuaaggacuggaagaacaucguggauaaacaacucaagaaggagauccggcggcugauccugagcuacggcaaguucgacgcugagauccucaacaaguacuucaaggaccgcaaguacaucuuuaaggacguggacaucuccaaggucgauguauacuauuuugagacggaguacguugcgacccggaagaaccuggacaccagcuucgaccgcaagaguauagaguccaucacagacacggggauccagaagauccugcucaaccaccugggaguaaagaacaacaaccccgagcuggccuucagcgcggaagggaucgacgaaaugaaccaacggaucguggaacucaauggcggcaagcaacaccagcccaucuacaaggugcgcauguacgagccgcuugggaacaaguuccaggucggccggaucgguaacaaaaaggacaaguacguggaagcagcccccggcacaaaccuguucuaugcgaucuaccaguccgaggauaaaaagcgcaucuacgacaccaucccccucaacaucaucaucgagcggcagaagaaggaacuguuccccgugccagagaacaaagaggacaaggacaaccuguacaagcuccuguucuggcugagcccgaacgacauggucuaccugcccacugagaaggagugggccaacccagaccuguucaacuucaacaacaugacgaagaaccagcgcaagaaacuuuauaaauucaucgacggauccggcaccaccgccaacuucaucccgaacaccguggccaauaucaucuucagcauccccaagaaggacuccggcaaguacagcauggggaaccggaucguucagaacgaguucggcaucggaucuccgcagagcaagaaccagaaagccuucacgggcgaaaugaucaaggagcgcugcuggaagcucaagauaaaccggcugggggacaucaucgaaugcaucaaguga

SEQ ID NO: 8092 - RNA, 4629 nt, Artificial Sequence
  Cas9 variant
auggagaagcgcauccuagggcucgauuuaggaacaaacagcauaggaugggcacucgucaagggagaacgacacgagaaugacaacgaaacgauccucucguacauagaagcugcaggcuccagaauccucccccuagacgccgcagcgcagggcgacuucgagaaaggcaaccccgcaaagacacaaaccagugaaagaacacggaugcgcggaaugagacaccuccucgagcgcucccuccuaagacgggaacgacuacacaggguccuggacaucauggacuuucuuccuccacauuacucccaaagccuaacacgguacggaaaauucaaagcagacacagaaugcaagcuagcauggcgaaaaaccgaaacaggccauuacgaguuccuuuuccaagacuccuuccaagagaugcuucaagacuuccagaaccaugggaaacuagaggaaaauaagaaaauccccuacgauuggacaaucuacuaccuaagaaagaaagcccucacacaacccgucuccaaacaagaacuagcuuggauucuucuuaacuucaaccagaaaaggggauacuaucagagggaagaucaggcagucgacgauaaccaaaagaaacgggucgaguaccaagcauugaaagucauaucuguugaagauaccggcgagaagaaagggaaaaacacgugguacgacguccgccuggaaaacggcuuaguauaucacuacagcgcaccaauaaaaccugacuggaaaggcgagaccaaggaguucauagucaccaccaccauagaccaaaacgguaaaccagaacuggacaaagacgguaaaccaaaguauaguaugcgagccccgaaggaggacgacuacaaacuucuaauggagaaaaccaagaaagacauaacugacagcggcaaaaguguuggagaauauaucuacgacgcauugcugguaaacccgcaacagaaaaucagaggugggcuuguccgaacgauagaacgcuacuuuuauaaaaaggagcucgagaaaauccuccucucucaagaacgcuuuauacccgaauuaaccgacagagaacucuaccgccgaugcgucgaagaacuguacccauccaacgacgccuaccgucaccugauagaaucaagggauaugcgauaucuccuaguagaagacaucuuguuuuaccagcgcccccucaaguccaagaaaucacucaucgaugacugccccuaugagucacgcuccuauguggacagggaaacgggcgaaaucaaaagcagcccagucaaaugcauagcccaaucucacccgcuauuucaggaauuucgccuguggcaguucauacacaaccugcgaaucuaccaaaacgagcgaagcgucgagggaaaauuacagcuggacguagacguaacggaagaagucuuaccgacccccgagagcaaagcggcacucuuuagguuccuaaaugaccgugagaacguaacacaggaaauccuccucaaagaaguauucaaaggccggaaacucagcgugaaagacugccccuaccgguggaacuacgccggugaaggaaagaaauacccgugcaacgaaacccgccaccugaugcugaaacuccuaaagaaggccggcaucgauacggccuuccuaaccccagaaaaggaacaggcacuauggcacaucauguacuccguugaagacaaagaccaauacgagaaagcccuaucaacauucgccaggaaaaaugaccugccggacggcuucaaagaacaguucaagaaagcaccaacauucaaaaaggacuacggugcuuacucccuccgcgcaaucaaaaagcuacuaccgcucaugcggguaggagaauauuggagcgcggacugcaucgacagugaaaccaaagaacggaucagccaaauaauccggggcgaaauggacgaaaaagucagccagcggaugacaaaauccagggacucguucacggauauaucgcaauuccaagggcuccccguguggcaagccugcuacguagucuacggcagacacuccgaagcuaccgaaauacaacgcugggaaaagcccgaagacauagacguguaccucaaggccuucaaacaacacucacuacggaaccccauaguggaacaagucgugcucgaaacccucagagucguucgcgacauauggaaaacauauggaaaggucgaugagauucacaucgaaauggggcgcgacaugaagaacaccgcugaggagcgaaagcgcauuuucaaucgaaaccagcaaaacgaaaacgauaaccuccgcaucaaagcccuacucacggaguucaugaaucccgacuuugaaaucgaaggcguccgaccauacagcccaagccagcaagaagcacugagaauauacgaagacggggccuggagcgggcucgacgaagaaaaagaagacaagaaagagcuagaagccauccgggaaauacucggcaaauucagccaaagcgacaaagccaaacgcccgacccacagcgaaguccugcgcuacaaagcauggcuagagcagcgcuacucguccccguacacaggggaggccauacccuuagccaaacuuuucacaccggcauacgagaucgaacaugucaucccccaauccagguucuucgaugacucauucucuaacaaagucguaugcgaggcagagguuaacaaacucaaagaucggaugcuaggguacgaguucaucaaagcccaccaaggcgaaguagucucccuaucggguacaggaagaugcgcacggauccucagcccagaagaauacgaacagcgcgucacagacugcuacaagcauaauacagccaaaaugaagaaacuccuaauggaagaaaucccagacgacuucauccagcgccaaaugaacgacucccgauacauaucaaaacucgucaaaucucuauuaucaaacaugguacgagaagaaggagaacgagaagccauaaguaagcaugucaucacgugcaauggcacaaucacugauagacucaagaaagacuggggugucaacgauguguggaaccacaucauacuaccacgauuccagaggaugaaagaccugaccgggcgaaacgacuucguugcagucaacagccagggccacgaaaucccaagcguacccccggaauugcaaaaaggcuuuaaaaagaaaagaauagaccacaggcaccacgcgauggacgcaaucgucauagcgugcacgacaagaaaucacgucaaccuacucaacaacgaggccgccaugagcgagaacaaggcgaaucggaucgcccugucaaggaagcugcgacguuacgagaacugugcaauuuauaaaggaggagaaaccaaaaacauauccgucgccaaggaguuccucaagccaugggcaacguucccggcagacguagaacgcgcccuaggcgacaucgucgugucauucaagcaaaaccuucgggugauuaacaaagcaacaaaccacuacgaacacuacaaagacgggaagaagguaaagguaccccaaaagaaaggagauauguggguaguccggaaaccgcuccacaaagacaccgucuacgcacuugucaaccuaagaaacgucaaaaccguugggcugaaggacgcaauccuuaugccggauagaauagcgaacaaagaccucaaaaagaaaguaaaagaacuccuggcacaaggggacgaccugaagaaaaucaagaaauacuucgagacagagaaagacacauggcaggacguagacgucaagaaaauagaaguauacuacuucucugaggaaacagcaaaccacuacuacgccacccgcaaaccauucgacgccaacgugaaaaucgacagcgugacagacacagggauacagaaaauucuacgaagacaccucgaggagaacgggaauaaggccgacguagcguucucacccgaaggaaucgcccguaugaaugagaacaucuuccgccucaaugggaacaagcaccaucaaccgauauacaaagugagaguauacgaaaaagcuaacaaauaccccgucggccaaacaggaaacaaggccuccaaauuuguagaagcggccaaaggaacgaaccuguaccucgccgucuacgaaucggaagucgucgacaagaaaacagcagagaucaguaagaaacgcaguuacgucaucguuccccuccgagacgcagucgcccgucaaaaacaaggcguucccgucgcgcccgaacgcaacgaagaagggggcaaacuccuguucguauuauccccaaaagauuuugucuacguccccacagaagaagagaggagcaaaggagagguauuacugccgcuagacaaaaaucgaaucuauaucaugauggacgccucagauggcaucgucaacuuccugccguacagcguagccaaccucaucuaugcacucccgaaagaccaggcuuccggcuucugcacagacggucgaaugauccaaaacgaguucggacuaggaucgcccaaauccaaaaacgaacgagcgcucacaggcgaaaugauaaaggagauaugccuaccgguaaaaguagaccgauuaggacgcaucacagagaucaaugguaacaaaguauga

SEQ ID NO: 8093 - RNA, 4644 nt, Artificial Sequence
  Cas9 variant
augaagaagauccugggccucgaccuggggaccaacagcaucggcugggcccugacgaauaacgacuucgacaacaagcucggguccaucgagggccuggggagccgcaucauccccaugucccaagacgugcugggcaaguucgacagcggcgucuccaucagccagacggccgagcggaccaaguaccgcgggacccggcgccucgugcagcgguuccugcuucgccgggagcgccuccaccggauccugaacauccuggacuuccucccgcgccacuacuccgaggcgaucgacuucgacaagaaguucggccaguucaagcccgaacgggaggaaaagcugagcuucuacaagaaugaguccgggaagaaccaguuucuguuccucgagagccaucaggagauguucuccgaguucaagcugacccaccccgaccugaagcagguccccuacgacuggacgaucuacuaccuccgcaagaaggcccugacccagaaaaucagcaaggaggaacuggccuggaucauccucaacuucaaccagaagcggggcuacuaccagcugcgcggggaggaggaggaggugaauaaaaacaagcuggaggaguuccacacccucgugaucguggacgucaucgagcgggagaagggcaaguccggcgugugguacaacgugauucuggagaacggguggaucuauaaacgcgagagcaagaucgcccuguucgacuggaucggcaagcagaaaaacuucaucgucaccacggagcucaacgacgacgggaccaucaagcugaacaaggacaacgaagagaagcgguccuuccgcagcccgaaggaggacgacuggggccugcggaagauccgcaccgagcagaccaucaaccaguccgaaaaguccgugggcagcuucaucuacgacgagcuccugaaaaagccuaaccagaagaucaagggggagcuggugcggacgaucgagcgcaaguucuacaaggacgagcucagcaagauccucaaagcccagaucaccuuccauuacgagauccugggcgaccgcaacaucuacaagaagugcaucgacgagcuguaccggcacaacgacagccacaagaacaacaucaaggacaagggguucgacuaccuguuccuggacgacaucaucuucuaccagagaccucucaaguccaagaccagccugaucuccgacugcagccuggaguucguccccaucaaggacaagaagggcauccucgugaaggacuccaacgggaagcaggucgugaagccgcugaagugcaucgccaagagcaaccccaucuuucaggaguuccggcugcuccaguucgugaagaaccugaagaucuacaagaaggagaucaucaacgagaucgacgugaccaacgacuaucugaagacggaggaggaccucgucgagcuguucgacuggcugaacgacaaggcggaaaucucccagaagcaguuccuggccuaccccaaguucaagcucaaggaggacaaguaccgguggaacuucguggaggauaagaucuaccccugcaacgagacccggaaccaguuccugaacgccaucgcgaagaucgacgucaacaagagcuucuucgacgccaagaacacccaggaccuguggcacauccucuacuccgucaccgacaagacggagcuguucagcaucaacaccgagaccggcauccaguccggcgcccugagcaccuucgccaagcgccacaaccucuccaacgaguucgugagcaacuucuccaaaauaaagccguacaacaaggacuacgggagcuacuccgagaaggccaucaagaaguugcugccccucaugcgguucggcuccaacuggaauaaaaacaacaucgacgcgaagacgcuggcccgcaucgauaagcugcagaccggggaguucgacgaaaccaugcggacccgcgugcgggagaaggccauccaccugucaaagaucacggacuuucagggccugccccucuggcucgccagcuacaucaucuacgaccgccacagcgaggcuuccaacaucagcaaguggaagacgcccgaagacaucgcgugguuccugaacccgaagaacaaguccgguuucaaacagcacagcuugcggaaccccauagucgagcaggucaucaccgagacccuccgcguggugaaggacaucuggcagcacuacggcgagggcaaggagaacuucuucaacgagauccacaucgagcuggggcgggaaaugaagaacaacgccaacgaccgcaagcggaucacggagaccaucaaccagaacgagaauaccaaccugcgcaucaaggccauccucaccgagcugaagaacgacggcaucaacgacgugcggccuuacucccccagccagcaggagauccugaagaucuacgaggagggggucuacaacuccgagauccgcaaggagaagcucgaggacaucgacaagauccguaagaacgccaagccgacgcccagcgagaucaucaaguacaagcuguggcuggaacagggcuacaucucccccuacaccgggaagcucaucccccugagcgaccuguucaccaccaaguaccagaucgagcacaucaucccgcagucccgccucuucgaugacagccuguccaacaaggugaucugcgagagcgaggugaacgaccugaagggcaacaacaccgcccucgaguucauccugaagaacgagggccgaaucguacugcucaccgggggcaagacggugaagaucuucaccaaggaggcguacaaccaacacaucaccuccuacuacaucaagaacaagagcaagcagaagcggcuucugacagaggagauccccgagaaguucaucgaccgccagcucaacgacaccaaguacaucuccaagaucgugaaaaaccugcugagcaagaucguccgggaggaggacgagcaggaggugaccagcaagcacaucgugucccucaacgggagcaucaccucccgcaugaagcaggacuggggccugaacgacgucuggaacaagaucgugagcccccgguucgagcgucugaacgcaauaacgaacuccaacgacuucggcaagcucgagcugaagaaggacgaguucgggaacgccggcaagcaggucuuccagaccaccgugcccgacgacaucgccaagggcuucagcaagaaacggaucgaccaccgccaccacgcccuggacgcgcucgugaucgccuguaucaaccggacccacaucaacuaccugaacaaccugaacgccaaggacgagaacgacaagacgaucaagcaugagcuccgcaacaagcugugcuucaagaccaagccggacuccaauggcaacagcaagugggaguuccacaagcccugggaaaacuucaccaagaagguggaagacgagcugaaccagaccaucaucuccuucaagcagaacacgcgggucaucaacaagaccgugaacaaguaccagguguggaaggaggaggacggggccaugaagaaggucaccgugaagcagaccaagggcgacaacugggcgauccgcaagcccauccacgccgagacggugagcggcaaggucuuccucaagcggaucaagcagucacacaucaccaucgccaacgccaucgagcagaucgagcugaucguggacaaggaggugcgcaagcagcugaaggccaagaucaagcaguacccgaacaacaaggagggguucaagaagcaccucaaggcguuccccaucaugaucaacggcaaggccaucgacaagguccagaucuacgagaccaucgaggccaccgccacacgggagcgcaacaaccuggacaucaccuucgacgagaagaagaucgagaagaucaccgacaccgggauccagaagauccugcucaaccaccugaagcaggagaucuaccagaacgccaucgaugagagcggcaagaagaucgcgccccacgagguggccuucuccgagaucgggaucgacgagcugaacaagaacauaaaggugcucaacaacgguaagaaccaccagccgaucaagaagguacggaucuucgaggagagcaagcgcuucucccugggccagagcggguccaagacggacaaguacguggagaccgccaagggcaccaaccuguucuacgccaucuacgaggggaagaagggcaaccggaacuacaagaccaucccgcucaacgaggugaucgagcgccagaaacaaggacugaacagcgcccuggucacggacgagaaugagaaccgccuccuguucacccugucccccaacgaccucguguacaucccgaccaacgaggagaagaagaaccugaccacgauuaacuucgacaagcugagccgggagcagaccgagcgcaucuacaaguuugugagcugcaccuccggcgagggccacuucgucagcaacaacuacuccaaggagaucauuagcaacgagaacggguccaacaacaagaacgagcggaugcucgaguucaacaauagcaacacuaucuacgacgagaaggagaagcccgugaugaucaaguccguguguuggaagcuggaggucgaucgccugggcaagaucaagcggaucauccgcuga

SEQ ID NO: 8094 - RNA, 4677 nt, Artificial Sequence
  Cas9 variant
augaagaagauccugggccucgaucuggggaccaacagcaucggcugggcccuggugaaugucgacaagaacgggaaccccuucggcaucgaggggcuaggcucccgcaucaucccgauggaccaggccacccugagcgacuucgagaagggaaacuccaagagccaaacggcggagcggaccauguuccgcggggcccggcgccugcgggagcgcaagcaccuccggcgcgagcggcugcaccgcauccugaacgagcucaacuuccugcccauccacuaccgguccugcaucgacuucgugcaccgccugggcaaguucaaggccaaccacgagcccaagaucgccuggcggagcaacgaccaggacaagauggaguucaucuuccaaaauuccuuccucgagaugaugagcgauuucaccaagcgccagcccgagcuggugaaggaagggaagaagaucccguacgacuggaccaucuacuuccugcggaagaaggcccucggccagcgcaucgagaaggaggagcuggcguggcugcuccugcacuucaaccagaagcggggguacuaccagcugcgcggcgaggacgagaucgacgccacucgguccgccaagacccgcaaguacuucgaccggaagaucauuaagagcaucaucgacaccggcgaggaguacaaggggcucaagguccugaucguggagcuggacaacggcaaccaagggaagaucuucaagcaggaggugcccgauugggucggccaggagaagaacaucaucgccaccguggaccucgacaaggacggcaaggaccgcuucgacaagggggugcugucccagcgcuucagcauccccuccgacagcgagugggagacggaguggaagcugaucaagcucaagaccgaggaggaccuggaggcgucccagaagaccgucggcaccuacaucuacgacagccugcucaagaaccccaaccagaagaucaaggggaagcuggugcggacgaucgagcgcaaguacuaccgggacgagcugcgcgccauucucaacaagcagcgggaguuccacccggagcugaacgacaaaaagcuguaccagcacugcaucuucucccucuacccccagaacgaggccuuccgcaacagcaucgccaacaaggacuucacuuaccuguuccuggaggacaucaucuucuaccagcggccccucaaauccaagaaguccaccaucaacaacugcgccuacgaggugcgccgguacauggacaaggagaccaaggagcuuaaggaggucccccugaagugcaucgccaagagucacccgaucuuccaggaguuccgccucuggcaguucaucagcaaccugcggaucuacaagaaggacaucacggacaucgacgugaccaacgacuuccugcacagccaggacgacuacgcgaaccucuucgaguggcugaacaacaagaacgagaucgaccagaaggccuuccugaaguaccccgccuucggcuucaagaaggacgccgugaacuaccgcuggaacuacgucgaggacaagucauaccccugcaacaagacccggucggcgauccucuccaagcuggacaagcacgagcaggaguuccugaccaaggagcuggagcucaagaucuggcagcugcuauacagcgugaacuccaaggaggagaucgacaaggcccucaacgugaacagccccaagaucaacaacaagaucuccaucgaccacacggggauccugcacgagcucaagagcuccagccucuccgacaucagcauccagaggcugaaggccaucaacuucgaggagaaggacuacggcuccuacagcuacaaggccaucaagaagcugcucgcgcugaugcggcagggcaaguacuuugacaacaccgcaaucaccgacgccaccaaggcccgcauaaacuccaucuucgaccggcuggagagcaucuccuucgacccugagcgcaucaacagcaucagcgacgacgacauccccaagcagauccucaagucguucaucaagcugaaccggacguacgggggcuucaacaccuaccaggccugcuacgccgucuacgggcgccauagcgaggcgaaagaaaucgccaaaugggagaagccggaggacaucgaccaguaccuggccaaguucaagcagcacucccuccgcaaccccaucguggagcagaucaucaccgagacccugcgggugguccgcgacaucuggaaaaagcacgccuacaagacgaucaacaaggacaaccagggcaacaacugcgagagcgaguccgagcugaccgagauccacaucgagcucgggagggacaugaagaacaacaagagcgagcgccugcggaucucccgcaucaacagcgagaacgagaacaccaaccugcggauccgcaagcuccugaucgaguucaacgacccggaguucggaguggagaacgugcggccccacucccccagccagcaggagauccugcgcaucuacgaggacggcguccuaaaguccgggguggagauccccgaguacgucgacaacaucaucaagaaguucaaggagaccgacgugaagaagcagccgagcaaguccgaggugcugcgguacaagcuguggcucgagcagaaguaccgcagccccuacacgaacgaggugaucccccugggcaagcuguucacgaacgacuaccagaucgagcacaucaucccccagucccguuacuucgaugacagcuucuccaacaaagugaucugcgaggcggaggugaaccagcucaaggagaacgagcuggggugcgaguucaucaugaacaacggcgggcgcaucgucgaacugagcuucggcaagaccgugcggauccucgacuucgaggccuaugagcaguucgugcagcagaacuacgccggcaaccguccgaagcuccggaaccugcucaugaccgagauccccaacgacuucauagaccgccagcugaacgacagccgguacaucaguaaggucgugaaggggcugcucagcaacaucgugcgcgaggacggcgaggccgaguccacgagcaagaaccugaucuccugcaccgggggcgucaccgcgcggcugaagauggacuggggccucaacgacguguggaacaaccugaucuacccccgcuucgagcgccuuaacgagcucaccaacagcaaccaguucggguacugggauaagaaggacggcaagaacguauuccagacccaggucccgauggacauccagaagggguucaacaagaagcggaucgaccaccgccaccacgcgcuggaugcccuggugaucgccugcgccacgcggucucacaucaacuacuuaaacaacgagagcgccaaguccaacagcaaggagucccgcuacgaccugcggcgcaagcugcggcgccucgaggugauccagaaggaguacaccaucaacggccggaaggagauccgcaacaucgaggucgcgaaggaguucuacaagcccuggaacagcuucacccaggacgcccaguccgcccuggagaacaucguggugucguucaagcagaaccugcgggucaucaacaagaccacgaacuauuuccuacgcuucaacaaggaagggaagaaaaucuucgagacccagaccuccggcagcaacugggccauccggaagccgcuucacaaggacaccgccuucggccuggugaaccucaagcgcaccaagaccgugucccuggcgaacgccauccuggacuaugaccagaucgugaaccggaagcucuggaccaagaucaaggagcucaucagcaucggguacgacaacaagagaauccugaaguauuucacggacgacaaggagaacuggaacgagaucaucuccagcggcaucgagguguucuacuacacagacaacuucgagaagcaggucgccacccggaagccccucgacaccagcuuuacagaguccaagaucauuaacagcaucacggaccuggggauccacaagauucugcucgcccaccuccgcgcgaacgagggcaacccgaacaucgccuucucccccgaagggaucgagaccaugaaccggcacaucugcgagcugaacggcggaaaguuccaccacccaaucuacaaggugcgggugcaugagccccugggguacaaguucaaggugggcgacaaggggaaccgcagcaccaaguacgucgaggccgccaagggcaccaacuuauucuuugggaucuacaucaacucccagggcauccggagcuacgagacaaucccgcugaacguggccaucgagcggcagaagcagggccucucccccgugcccgacaacaacgaacugggggagcggcugcuguucuggcugucucccaacgaccuggucuaccucccgaccuccgacgagguggagagcggcaucugcugcaacaagcuggggaucgaccgcaucuacaagaugguguccugcaccggcuacgucggggacuucauccccgcgcacaucgcuaaccccaucauccagacccuggagcucggcagcaacaauaaggcccagcgggccuggacgggcgagaugaucaaggagaucugcauccccgugaagguggaccgaauggggaacaucgucgagaucuucaaccggaacaagaacuga

SEQ ID NO: 8095 - RNA, 4695 nt, Artificial Sequence; identical to SEQ ID NO: 2295
  Cas9 variant

SEQ ID NO: 8096 - RNA, 4713 nt, Artificial Sequence; identical to SEQ ID NO: 2296
  Cas9 variant

SEQ ID NO: 8097 - RNA, 5067 nt, Artificial Sequence; identical to SEQ ID NO: 2297
  Cas9 variant

SEQ ID NO: 8098 - RNA, 3924 nt, Artificial Sequence
  Cpf1 variant
augacccaguucgaaggcuucaccaaccuguaccaggugagcaagacgcuccgcuucgagcugaucccccaggggaagacccugaagcacauccaggagcagggcuucauugaagaggacaaggcccggaacgaucacuacaaggaacucaagccgaucauagaccgcaucuacaagaccuacgccgaccagugccugcagcugguccagcucgacugggagaaccuguccgcggccaucgacagcuaccggaaggaaaagaccgaggagacgcgcaacgcccuaaucgaggagcaggccaccuaccggaacgccauccacgacuacuucaucgggcgcaccgacaaccucaccgacgcgaucaacaagcggcacgccgagaucuacaagggccuguuuaaggccgagcuguucaacgggaaggugcucaagcagcuugggacuguuaccaccaccgagcacgagaacgcccugcuccgcuccuucgacaaguucacgaccuacuucagcggcuucuacgagaauaggaagaacgucuucuccgcggaggacaucagcaccgccauaccccaccgcaucgugcaggacaacuuccccaaguucaaggagaacugccacauuuucacccgguuaaucacggccgugcccucccuccgcgagcacuucgagaacgucaagaaggccaucgggaucuucgucagcaccuccaucgaggagguguucagcuucccguucuacaaccagcuccuuacccagacccagauagaucuguacaaccagcuccuaggcgggaucucccgggaggccggcacggagaagaucaaggggcugaacgaggucuuaaaccuagcgauccagaaaaacgacgagaccgcccacaucaucgccagcuugccccaccgcuucaucccccucuucaagcagauccuguccgaccggaauacccugagcuucauccucgaggaguuuaaguccgaugaggaggugauacaauccuucugcaaguacaagacccugcugcgcaacgagaacgugcuugagacggccgaggcgcuguucaacgagcugaacuccaucgaucucacccacaucuucaucagccacaagaagcuggagaccauauccagcgcgcugugugaccacugggacacacuccggaacgccuuauacgagcgcagaauuucugagcugacgggcaagaucaccaaauccgccaaggagaagguccagcgcagucucaagcacgaggacaucaaccugcaggaaauuaucuccgccgccggcaaagagcuuucugaggcguucaagcagaagaccuccgagauccucagccacgcccacgcagcccuggaccagccuuugccgaccacgcucaagaagcaggaggagaaggagauucugaaaucccagcuggacagccugcucgggcuguaccaccuccucgacugguucgcaguggacgaguccaacgagguggaccccgaguucagugcgcggcugaccggcaucaagcuggagauggaacccuccuugagcuucuacaacaaggcccgcaauuacgccaccaagaagcccuacuccgucgaaaaguucaagcugaacuuucagaugccgacccuggccagcgggugggacgugaacaaggagaagaacaacggcgcgauccucuucgugaagaacggucuuuacuaccuggggaucaugcccaagcagaagggccgcuacaaggcccucuccuucgaaccaacggagaagaccagcgagggcuucgacaagauguacuacgacuacuuccccgacgccgccaaaaugaucccaaagugcuccacacagcugaaggccgucaccgcgcacuuccagacucacacgaccccaauccugcucagcaacaacuucaucgagccccuggagaucaccaaagagauuuacgaccugaacaaccccgagaaggagccgaagaaauuccagaccgccuacgccaagaagacgggugaccaaaagggcuaucgggaggcccucuguaaguggaucgacuucacccgcgacuuccuguccaaguacaccaagaccacgagcaucgaccugagcuccuuacggcccagcucccaguacaaggaccucggcgaguacuacgcugagcugaacccccuccuguaucacaucagcuuccagcguaucgcggagaaggagaucauggacgccguggagacaggcaagcuguaccucuuccaaaucuauaauaaggacuucgccaaagggcaccacggcaagcccaaucugcacacccuuuacuggacaggccucuucucaccggagaaccuggccaaaacgagcaucaagcugaacgggcaggccgagcuguucuacaggcccaagucccgcaugaagcguauggcccaccggcugggggagaagauguuaaacaagaagcucaaggaccagaagacccccauaccugacacccuguaccaggagcuuuacgacuacgugaaccaccggcucagccacgaccuguccgacgaggcccgcgcccugcucccgaacgucaucaccaaggaggugagccacgagaucaucaaggaccggcgcuucacguccgacaaauucuucuuccacgugcccaucacccugaacuaccaggccgcgaacucccccuccaaguucaaccagcgggucaacgccuaccugaaggagcacccggaaacccccaucaucggaaucgaccgaggcgagcggaaccucaucuacaucaccgucaucgacagcacggggaagauccuagagcagcgcucccuaaacaccauccagcaauucgacuaccagaaaaagcucgacaaccgggagaaggagcgcguggccgcccggcaggccuggagcguggugggcaccaucaaggaccuuaagcagggguaccugucccaggucauccacgagaucguggaccucaugauacacuaccaagcggucgucgugcuggagaaccugaacuucggcuuuaagagcaaacgcaccgggaucgccgagaaggccguguaccaacaguucgagaagaugcucaucgacaagcugaacugccugguccucaaggauuaccccgccgagaaggugggcggcgugcugaaccccuaccagcugacggaccaguucacgagcuucgccaagauggggacccaguccgguuuccucuucuaugucccggcgccguacaccagcaaaaucgacccccuaacgggguucguggaccccuucguguggaagacaaucaagaaccacgagucccgcaagcacuuccuggagggcuucgacuuccuccacuacgacgucaagaccggcgauuuuauccugcacuucaagaugaaccggaaccugagcuuccagcgcgggcuaccuggcuucaugcccgccugggacaucgucuucgagaaaaacgagacacaguucgacgccaagggcacacccuucaucgccggcaagcggaucgugccagucaucgagaaccaccgcuucaccgggcgguaccgcgaccuguacccggccaacgagcugaucgcgcuccuggaggagaagggcaucguauucagggacggcuccaacauucugcccaagcuccuggagaaugacgacagccacgccaucgacaccaugguggcccugauccgcuccguccuccagaugcggaacagcaacgccgcgaccggggaggacuacaucaacagccccguacgcgaccugaacggcgugugcuucgacagccgauuccagaaccccgaauggccuauggaugccgaugccaacggggccuaccacaucgcucugaagggccagcuccugcugaaccaccucaaggaauccaaggaccugaagcugcagaacgggaucagcaaccaggacuggcucgcguacauccaggagcugcgcaacuga

SEQ ID NO: 8099 - RNA, 3903 nt, Artificial Sequence; identical to SEQ ID NO: 2299
  Cpf1 variant

SEQ ID NO: 8100 - RNA, 1341 nt, Artificial Sequence
  Cpf1 variant
augaaacccgacaucaaagaccgagaauacauguaccgucucauuaucggacaacucuucuacgacggccaccaacaaaucgcagucaaccuagccaacacacucggcugcuccgccccacccccgccgcccuccgacaaacuauucagacuugucaccaucgccaagcaauucgucgaagaccccgacuacaaagcagaagaaaacacaaugcccaugcaauucgaaacaucauccgcuggccucgaccuccaauacgaugccgacguagccgccacauccccagaacccucccaauacgaaaccauauaucucacuguccacaaagcccccugccgcgccgccgcauucaacuccgacggcucgcucaucgccaccggcuccgccgacugcuccaucaaaauuauggacgucgaacgcauacuagcccgcgaaaaagaacaccgcgaaaugaacgaaaacggccccgacgcacaccaccccgucauccggacccucuacgaccacguugacguccgccgcgacuucggccgcuucuccgacaaaauucucgacuuccaagacgucaacaccgucaucuuccauccccgcgacgcaauacucauauccggcuccaacgacaaaacaguaaaacucuucgacuucucuaaaacugccgucaaacgagccaugaaaacccucuccgaagucuaccccgucagagcauuaucaugucaccccgguggagaguuccuccuuguagccaccgaccaccccacaguccgucuuuacaacaucgaaaccgcccaagccuacgccagcgccaaccccgacgaccaacaccgcgaaucagucacagacguccacuauuccgaaaacgcccgucucuacgucaccgccagcaaagacggugacguaaaagucugggacggcguaucaucccgcugcgucgaaaccuucaaacgcgcccacgaugguucauccaucugcucugccaaauucaccaaaaacggcaaauacauccuaacuagcgggauggacuccaucguuaaacucugggaacuuucaaccaaccgcugccucauuguauacacaggcgcaggagccacaggcgcacaagacuacccaacgucagccagcuucaaccaaaacgaagacuuuguccuauucccagacgaaaaaucaggcuccaugugcucaugggaagcacgaaacgccgaccggaaacgacuacuugcccucggccacacaucagcaugcagaaccuucguccacucccccuccaugcccgccuucaugaccggcuccgacgaccaccgcgcacgcuucugguaccgcaaacccacaaccaacgacaacuga

SEQ ID NO: 8101 - RNA, 1293 nt, Artificial Sequence
  Cpf1 variant
augaaaccagacauaaaagaccgcgaauacauguacagacucaucauaggccaacucuucuacgacggacaccaacaaauagccgucacacuagccaacacacucggcugcuccgccccagcacccccacccucagacaaacucuaccgccuagucacaauugccaaacaauucgucgaagaccccgacuacaaagcugaagaaaaaucccugcccaugcaauucgaaaccgucagcaccggccucgaccuagaauacgacgccgacguccaacccgucucccccgaaccuucacaauacgaaacuaucuaccucacaguccauaaagcccccugccgagccgccgccuucaacagcgacggcucccucguggccacaggcuccgcagacugcuccaucaaaaucauggacgucgaacgcauacucgcccgcgaaaaagaacacagagaaaugaacgaaaacggacccgacgcccaccaccccgucauccgcacccucuacgaccacgucgacgauguaaacacaguccucuuccacccccgugacgcgauccucauauccgguuccaacgacaaaacgguuaaacucuucgauuucuccaaaaccgccgucaaacgcgccaugaaaacacuaucagaagucuaccccguccgcgcacuaucaugccaccccggcggagaguuccugcucgucgccaccgaccaccccaccguacggcucuacaacaucgaaaccgcccaagccuacgccuccgccaaccccgacgaccaacaccgcgaaucaguaaccgauguacacuacucggaaaacgcucgccucuacguaaccgccucaaaagacggcgacgucaaaauaugggacggcguauccaaccgcugcguagaaacuuuuaaacgcgcacacgacggaucugccauuugcuccgcaaaauucaccaaaaauggcaaguaccuccuuaccuccggcauggacucaaucgucaaacucugggaacucucaaccaaccgaugccucauagucuacaccggcgccggcgcaaccggugcccaagacuacgccaccuccgcauccuucaaccacaacgaagacuacguacucuuucccgacgaaaagagcggcucaaugugcucuugggacgcccgcaacuccgaccgcaaacgccuacucgcacucggccacaccuccgccugccgaacauucguccacucccccuccaugccagccuucaugaccggaucggacgaccaccgagcccgcuucugguaccgcaaaccagccacaaccgacaacuga

SEQ ID NO: 8102 - RNA, 3690 nt, Artificial Sequence; identical to SEQ ID NO: 2302
  Cpf1 variant

SEQ ID NO: 8103 - RNA, 3903 nt, Artificial Sequence; identical to SEQ ID NO: 2303
  Cpf1 variant

SEQ ID NO: 8104 - RNA, 1071 nt, Artificial Sequence
  Cpf1 variant
augaaaaccaacuaccacgacaaacuagccgcaauagaaaaagaccgcgaauccgcgcgaaaagacuggaagaaaauaaacaacaucaaagaaaugaaagaaggcuaccucagccaagucguccacgaaauagcaaaacuugucaucggcuacaacgccaucguagucuucgaagaccucaacuucggcuucaaacgaggacgcuucaaaguagaaaaacaagucuaccaaaaacucgagaaaaugcuaaucgaaaaacucaacuaccucgucuucaaagacaacgaguucgacaaagccggcggaguccucagagccuaccaacucaccgcgcccuucgaaacauucaagaaaaugggcaaacaaacgggaaucaucuacuacguccccgccgacuucaccucaaaaaucugccccgucaccggcuucgucaaccaacuauaccccaaauacgaauccgucucaaaaucccaagaguucuucagcaaauucgacaaaaucugcuacaaccucgacaaaggcuacuucgaguucuccuucgacuacaaaaacuucggcgacaaagccgccaaaggaaaguggacaaucgccuccuucggcucccgacucaucaacuucagaaacuccgacaaaaaccacaacugggacacccgcgaagucuaccccaccaaagaacucgaaaaacuccucaaagacuacagcaucgaauacggacacggagaaugcaucaaagccgcaaucuacgccgaaaacgacaagaaauucuucgccaaacuaaccucgauccucaacuccauccuccaaaugcgcaauucgaaaaccggcacagaacucgacuaccucaucucccccguggcugacgucaacggcaacuucuucgacucccgccacgcccccaaaaacaugccccaagacgcagacgccaacggugccuaccacaucggccucaaaggccucaugcuccuuuaccgaaucaaaaacaaccaagacggaaagaaacucaaccucguaaucaaaaacgaagaauacuucgaguucguacaaaaccgaaacaaaucauccaaaaucuga

SEQ ID NO: 8105 - RNA, 3792 nt, Artificial Sequence; identical to SEQ ID NO: 2305
  Cpf1 variant

SEQ ID NO: 8106 - RNA, 2820 nt, Artificial Sequence; identical to SEQ ID NO: 2306
  Cpf1 variant

SEQ ID NO: 8107 - RNA, 3795 nt, Artificial Sequence; identical to SEQ ID NO: 2307
  Cpf1 variant

SEQ ID NO: 8108 - RNA, 3903 nt, Artificial Sequence; identical to SEQ ID NO: 2303
  Cpf1 variant

SEQ ID NO: 8109 - RNA, 3756 nt, Artificial Sequence; identical to SEQ ID NO: 2309
  Cpf1 variant

SEQ ID NO: 8110 - RNA, 4173 nt, Artificial Sequence; identical to SEQ ID NO: 2310
  Cpf1 variant

SEQ ID NO: 8111 - RNA, 4026 nt, Artificial Sequence; identical to SEQ ID NO: 2311
  Cpf1 variant

SEQ ID NO: 8112 - RNA, 4107 nt, Artificial Sequence; identical to SEQ ID NO: 2312
  Cpf1 variant

SEQ ID NO: 8113 - RNA, 4149 nt, Artificial Sequence; identical to SEQ ID NO: 2313
  Cpf1 variant

SEQ ID NO: 8114 - RNA, 4203 nt, Artificial Sequence
  Cas9 variant mRNA product
auggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguga

SEQ ID NO: 8115 - RNA, 4986 nt, Artificial Sequence
  Cas9 variant mRNA product
auggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguga

SEQ ID NO: 8116 - RNA, 3258 nt, Artificial Sequence
  Cas9 variant mRNA product
auggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguga

SEQ ID NO: 8117 - RNA, 4326 nt, Artificial Sequence
  Cas9 variant mRNA product
auggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguga

SEQ ID NO: 8118 - RNA, 3402 nt, Artificial Sequence
  Cas9 variant mRNA product
auggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauga

SEQ ID NO: 8119 - RNA, 4263 nt, Artificial Sequence
  Cas9 variant mRNA product
auggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguga

SEQ ID NO: 8120 - RNA, 3345 nt, Artificial Sequence
  Cas9 variant mRNA product
auggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauga

SEQ ID NO: 8121 - RNA, 4101 nt, Artificial Sequence
  Cas9 variant mRNA product
auggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguga

SEQ ID NO: 8122 - RNA, 4134 nt, Artificial Sequence
  Cas9 variant mRNA product
auggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguga

SEQ ID NO: 8123 - RNA, 3267 nt, Artificial Sequence
  Cas9 variant mRNA product
auggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauga

SEQ ID NO: 8124 - RNA, 3345 nt, Artificial Sequence
  Cas9 variant mRNA product
auggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauga

SEQ ID NO: 8125 - RNA, 3351 nt, Artificial Sequence
  Cas9 variant mRNA product
auggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauga

SEQ ID NO: 8126 - RNA, 3051 nt, Artificial Sequence
  Cas9 variant mRNA product
auggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguga

SEQ ID NO: 8127 - RNA, 3462 nt, Artificial Sequence
  Cas9 variant mRNA product
auggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguga

SEQ ID NO: 8128 - RNA, 4020 nt, Artificial Sequence
  Cpf1 variant mRNA product
auggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguga

SEQ ID NO: 8129 - RNA, 3999 nt, Artificial Sequence
  Cpf1 variant mRNA product
auggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguga

SEQ ID NO: 8130 - RNA, 4716 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8131 - RNA, 5499 nt, Artificial Sequence; identical to SEQ ID NO: 2331
  Cas9 variant mRNA product

SEQ ID NO: 8132 - RNA, 3771 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8133 - RNA, 4839 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8134 - RNA, 3915 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8135 - RNA, 4776 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8136 - RNA, 3858 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8137 - RNA, 4614 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8138 - RNA, 4647 nt, Artificial Sequence
  Cas9 variant mRNA product
gggagagucccgcagucggcguccagcggcucugcuuguucgugugugugucguugcaggccuuauucaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8139 - RNA, 3780 nt, Artificial Sequence
  Cas9 variant mRNA product
gggagagucccgcagucggcguccagcggcucugcuuguucgugugugugucguugcaggccuuauucaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8140 - RNA, 3858 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8141 - RNA, 3864 nt, Artificial Sequence
  Cas9 variant mRNA product
gggagagucccgcagucggcguccagcggcucugcuuguucgugugugugucguugcaggccuuauucaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8142 - RNA, 3564 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8143 - RNA, 3975 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8144 - RNA, 4533 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8145 - RNA, 4512 nt, Artificial Sequence; identical to SEQ ID NO: 2345
  Cpf1 variant mRNA product

SEQ ID NO: 8146 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8147 - RNA, 5596 nt, Artificial Sequence; identical to SEQ ID NO: 2347
  Cas9 variant mRNA product

SEQ ID NO: 8148 - RNA, 3868 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8149 - RNA, 4936 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8150 - RNA, 4012 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8151 - RNA, 4873 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8152 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8153 - RNA, 4711 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8154 - RNA, 4744 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8155 - RNA, 3877 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8156 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8157 - RNA, 3961 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8158 - RNA, 3661 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8159 - RNA, 4072 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8160 - RNA, 4630 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 8161 - RNA, 4609 nt, Artificial Sequence; identical to SEQ ID NO: 2361
  Cpf1 variant mRNA product

SEQ ID NO: 8162 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8163 - RNA, 5280 nt, Artificial Sequence; identical to SEQ ID NO: 2363
  Cas9 variant mRNA product

SEQ ID NO: 8164 - RNA, 3552 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8165 - RNA, 4620 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8166 - RNA, 3696 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8167 - RNA, 4557 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8168 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8169 - RNA, 4395 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8170 - RNA, 4428 nt, Artificial Sequence
  Cas9 variant mRNA product
gggagagcggcucggccauuuugucccagucaguccggaggcugcggcugcagaaguaccgccugcggaguaacugcaaagaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8171 - RNA, 3561 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8172 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8173 - RNA, 3645 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8174 - RNA, 3345 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8175 - RNA, 3756 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8176 - RNA, 4314 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8177 - RNA, 4293 nt, Artificial Sequence; identical to SEQ ID NO: 2377
  Cpf1 variant mRNA product

SEQ ID NO: 8178 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8179 - RNA, 5222 nt, Artificial Sequence; identical to SEQ ID NO: 2379
  Cas9 variant mRNA product

SEQ ID NO: 8180 - RNA, 3494 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8181 - RNA, 4562 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8182 - RNA, 3638 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8183 - RNA, 4499 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8184 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8185 - RNA, 4337 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8186 - RNA, 4370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8187 - RNA, 3503 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8188 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8189 - RNA, 3587 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8190 - RNA, 3287 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8191 - RNA, 3698 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8192 - RNA, 4256 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8193 - RNA, 4235 nt, Artificial Sequence; identical to SEQ ID NO: 2393
  Cpf1 variant mRNA product

SEQ ID NO: 8194 - RNA, 4420 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8195 - RNA, 5203 nt, Artificial Sequence; identical to SEQ ID NO: 2395
  Cas9 variant mRNA product

SEQ ID NO: 8196 - RNA, 3475 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8197 - RNA, 4543 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8198 - RNA, 3619 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8199 - RNA, 4480 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8200 - RNA, 3562 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8201 - RNA, 4318 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8202 - RNA, 4351 nt, Artificial Sequence
  Cas9 variant mRNA product
gggagagucccgcagucggcguccagcggcucugcuuguucgugugugugucguugcaggccuuauucaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8203 - RNA, 3484 nt, Artificial Sequence
  Cas9 variant mRNA product
gggagagucccgcagucggcguccagcggcucugcuuguucgugugugugucguugcaggccuuauucaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8204 - RNA, 3562 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8205 - RNA, 3568 nt, Artificial Sequence
  Cas9 variant mRNA product
gggagagucccgcagucggcguccagcggcucugcuuguucgugugugugucguugcaggccuuauucaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8206 - RNA, 3268 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8207 - RNA, 3679 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8208 - RNA, 4237 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8209 - RNA, 4216 nt, Artificial Sequence; identical to SEQ ID NO: 2409
  Cpf1 variant mRNA product

SEQ ID NO: 8210 - RNA, 4530 nt, Artificial Sequence
  Cas9 variant mRNA product
gggagaggcgcugccuacggagguggcagccaucuccuucucggcaucaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8211 - RNA, 5313 nt, Artificial Sequence; identical to SEQ ID NO: 2411
  Cas9 variant mRNA product

SEQ ID NO: 8212 - RNA, 3585 nt, Artificial Sequence
  Cas9 variant mRNA product
gggagaggcgcugccuacggagguggcagccaucuccuucucggcaucaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8213 - RNA, 4653 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8214 - RNA, 3729 nt, Artificial Sequence
  Cas9 variant mRNA product
gggagaggcgcugccuacggagguggcagccaucuccuucucggcaucaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8215 - RNA, 4590 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8216 - RNA, 3672 nt, Artificial Sequence
  Cas9 variant mRNA product
gggagaggcgcugccuacggagguggcagccaucuccuucucggcaucaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8217 - RNA, 4428 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8218 - RNA, 4461 nt, Artificial Sequence
  Cas9 variant mRNA product
gggagaggcgcugccuacggagguggcagccaucuccuucucggcaucaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8219 - RNA, 3594 nt, Artificial Sequence
  Cas9 variant mRNA product
gggagaggcgcugccuacggagguggcagccaucuccuucucggcaucaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8220 - RNA, 3672 nt, Artificial Sequence
  Cas9 variant mRNA product
gggagaggcgcugccuacggagguggcagccaucuccuucucggcaucaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8221 - RNA, 3678 nt, Artificial Sequence
  Cas9 variant mRNA product
gggagaggcgcugccuacggagguggcagccaucuccuucucggcaucaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8222 - RNA, 3378 nt, Artificial Sequence
  Cas9 variant mRNA product
gggagaggcgcugccuacggagguggcagccaucuccuucucggcaucaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8223 - RNA, 3789 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8224 - RNA, 4347 nt, Artificial Sequence
  Cpf1 variant mRNA product
gggagaggcgcugccuacggagguggcagccaucuccuucucggcaucaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 8225 - RNA, 4326 nt, Artificial Sequence; identical to SEQ ID NO: 2425
  Cpf1 variant mRNA product

SEQ ID NO: 8226 - RNA, 4582 nt, Artificial Sequence
  Cas9 variant mRNA product
ggggcgcugccuacggagguggcagccaucuccuucucggcaucaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8227 - RNA, 5365 nt, Artificial Sequence; identical to SEQ ID NO: 2427
  Cas9 variant mRNA product

SEQ ID NO: 8228 - RNA, 3637 nt, Artificial Sequence
  Cas9 variant mRNA product
ggggcgcugccuacggagguggcagccaucuccuucucggcaucaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8229 - RNA, 4705 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8230 - RNA, 3781 nt, Artificial Sequence
  Cas9 variant mRNA product
ggggcgcugccuacggagguggcagccaucuccuucucggcaucaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8231 - RNA, 4642 nt, Artificial Sequence
  Cas9 variant mRNA product
ggggcgcugccuacggagguggcagccaucuccuucucggcaucaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8232 - RNA, 3724 nt, Artificial Sequence
  Cas9 variant mRNA product
ggggcgcugccuacggagguggcagccaucuccuucucggcaucaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8233 - RNA, 4480 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8234 - RNA, 4513 nt, Artificial Sequence
  Cas9 variant mRNA product
ggggcgcugccuacggagguggcagccaucuccuucucggcaucaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8235 - RNA, 3646 nt, Artificial Sequence
  Cas9 variant mRNA product
ggggcgcugccuacggagguggcagccaucuccuucucggcaucaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8236 - RNA, 3724 nt, Artificial Sequence
  Cas9 variant mRNA product
ggggcgcugccuacggagguggcagccaucuccuucucggcaucaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8237 - RNA, 3730 nt, Artificial Sequence
  Cas9 variant mRNA product
ggggcgcugccuacggagguggcagccaucuccuucucggcaucaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8238 - RNA, 3430 nt, Artificial Sequence
  Cas9 variant mRNA product
ggggcgcugccuacggagguggcagccaucuccuucucggcaucaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8239 - RNA, 3841 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8240 - RNA, 4399 nt, Artificial Sequence
  Cpf1 variant mRNA product
ggggcgcugccuacggagguggcagccaucuccuucucggcaucaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8241 - RNA, 4378 nt, Artificial Sequence; identical to SEQ ID NO: 2441
  Cpf1 variant mRNA product

SEQ ID NO: 8242 - RNA, 4484 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8243 - RNA, 5267 nt, Artificial Sequence; identical to SEQ ID NO: 2443
  Cas9 variant mRNA product

SEQ ID NO: 8244 - RNA, 3539 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8245 - RNA, 4607 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8246 - RNA, 3683 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8247 - RNA, 4544 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8248 - RNA, 3626 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8249 - RNA, 4382 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8250 - RNA, 4415 nt, Artificial Sequence
  Cas9 variant mRNA product
gggagagucccgcagucggcguccagcggcucugcuuguucgugugugugucguugcaggccuuauucaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8251 - RNA, 3548 nt, Artificial Sequence
  Cas9 variant mRNA product
gggagagucccgcagucggcguccagcggcucugcuuguucgugugugugucguugcaggccuuauucaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8252 - RNA, 3626 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8253 - RNA, 3632 nt, Artificial Sequence
  Cas9 variant mRNA product
gggagagucccgcagucggcguccagcggcucugcuuguucgugugugugucguugcaggccuuauucaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8254 - RNA, 3332 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8255 - RNA, 3743 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8256 - RNA, 4301 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8257 - RNA, 4280 nt, Artificial Sequence; identical to SEQ ID NO: 2457
  Cpf1 variant mRNA product

SEQ ID NO: 8258 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8259 - RNA, 5364 nt, Artificial Sequence; identical to SEQ ID NO: 2459
  Cas9 variant mRNA product

SEQ ID NO: 8260 - RNA, 3636 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8261 - RNA, 4704 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8262 - RNA, 3780 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8263 - RNA, 4641 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8264 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8265 - RNA, 4479 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8266 - RNA, 4512 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8267 - RNA, 3645 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8268 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8269 - RNA, 3729 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8270 - RNA, 3429 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8271 - RNA, 3840 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8272 - RNA, 4398 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 8273 - RNA, 4377 nt, Artificial Sequence; identical to SEQ ID NO: 2473
  Cpf1 variant mRNA product

SEQ ID NO: 8274 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8275 - RNA, 5300 nt, Artificial Sequence; identical to SEQ ID NO: 2475
  Cas9 variant mRNA product

SEQ ID NO: 8276 - RNA, 3572 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8277 - RNA, 4640 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8278 - RNA, 3716 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8279 - RNA, 4577 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8280 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8281 - RNA, 4415 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8282 - RNA, 4448 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8283 - RNA, 3581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8284 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8285 - RNA, 3665 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8286 - RNA, 3365 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8287 - RNA, 3776 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8288 - RNA, 4334 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8289 - RNA, 4313 nt, Artificial Sequence; identical to SEQ ID NO: 2489
  Cpf1 variant mRNA product

SEQ ID NO: 8290 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8291 - RNA, 5249 nt, Artificial Sequence; identical to SEQ ID NO: 2491
  Cas9 variant mRNA product

SEQ ID NO: 8292 - RNA, 3521 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8293 - RNA, 4589 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8294 - RNA, 3665 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8295 - RNA, 4526 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8296 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8297 - RNA, 4364 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8298 - RNA, 4397 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8299 - RNA, 3530 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8300 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8301 - RNA, 3614 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8302 - RNA, 3314 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8303 - RNA, 3725 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8304 - RNA, 4283 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 8305 - RNA, 4262 nt, Artificial Sequence; identical to SEQ ID NO: 2505
  Cpf1 variant mRNA product

SEQ ID NO: 8306 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8307 - RNA, 5235 nt, Artificial Sequence; identical to SEQ ID NO: 2507
  Cas9 variant mRNA product

SEQ ID NO: 8308 - RNA, 3507 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8309 - RNA, 4575 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8310 - RNA, 3651 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8311 - RNA, 4512 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8312 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8313 - RNA, 4350 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8314 - RNA, 4383 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8315 - RNA, 3516 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8316 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8317 - RNA, 3600 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8318 - RNA, 3300 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8319 - RNA, 3711 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8320 - RNA, 4269 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8321 - RNA, 4248 nt, Artificial Sequence; identical to SEQ ID NO: 2521
  Cpf1 variant mRNA product

SEQ ID NO: 8322 - RNA, 4433 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8323 - RNA, 5216 nt, Artificial Sequence; identical to SEQ ID NO: 2523
  Cas9 variant mRNA product

SEQ ID NO: 8324 - RNA, 3488 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8325 - RNA, 4556 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8326 - RNA, 3632 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8327 - RNA, 4493 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8328 - RNA, 3575 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8329 - RNA, 4331 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8330 - RNA, 4364 nt, Artificial Sequence
  Cas9 variant mRNA product
gggagagucccgcagucggcguccagcggcucugcuuguucgugugugugucguugcaggccuuauucaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8331 - RNA, 3497 nt, Artificial Sequence
  Cas9 variant mRNA product
gggagagucccgcagucggcguccagcggcucugcuuguucgugugugugucguugcaggccuuauucaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8332 - RNA, 3575 nt, Artificial Sequence
  Cas9 variant mRNA product
gggagagucccgcagucggcguccagcggcucugcuuguucgugugugugucguugcaggccuuauucaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8333 - RNA, 3581 nt, Artificial Sequence
  Cas9 variant mRNA product
gggagagucccgcagucggcguccagcggcucugcuuguucgugugugugucguugcaggccuuauucaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8334 - RNA, 3281 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8335 - RNA, 3692 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8336 - RNA, 4250 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 8337 - RNA, 4229 nt, Artificial Sequence; identical to SEQ ID NO: 2537
  Cpf1 variant mRNA product

SEQ ID NO: 8338 - RNA, 51 nt, Artificial Sequence; identical to SEQ ID NO: 4858
  NLS2 variant

SEQ ID NO: 8339 - RNA, 48 nt, Artificial Sequence; identical to SEQ ID NO: 4859
  NLS4 variant

SEQ ID NO: 8340 - RNA, 4107 nt, Artificial Sequence
  Cas9 variant
auggauaagaaauacucaauaggccuagauauaggaacaaauucaguaggaugggcaguuauaacagaugaauacaaaguaccgaguaagaaauucaaaguacuaggaaauacagaccgacauagcaucaagaaaaaccugauaggcgccuuacuuuucgacagcggugaaacagcagaagcaacaagacuaaaaaggacagcaagacguagauacacaagacguaaaaaucgaauuugcuacuuacaagaaauauuuucaaacgaaauggcaaaaguagaugauagcuucuuucauagauuagaagaaucauuucucguagaagaagauaagaaacacgaaagacauccaauauuugguaacaucgucgaugagguagccuaucacgaaaaauacccaacuauuuaucaucuacgaaagaaauuaguugacaguacagacaaagcugaucuucgacuaauauauuuggcccucgcacacaugauuaaauuuagagggcacuuuuuaauagaaggugauuuaaauccagauaacucggacguugauaaauuguucauacaacuuguacaaacguacaaccaacucuucgaagaaaacccaauaaaugccagugguguugacgccaaagcaauauuaucagcaagacuaucgaaaucacggcguuuagaaaaucugauagcccagcuacccggagagaagaaaaacggacuuuuuggaaaucuaauagcacuaucacucgguuugacaccaaacuucaaaaguaacuucgacuuagcagaagacgcaaaauuacaacugucuaaagauacauaugacgaugaccucgauaaucuauuagcucagauaggagaccaauacgcagaccuauuccucgcagcuaaaaaccuaucugaugcaauauuauuaucagacauacuucgaguuaacacugaaauaacaaaagcuccccucuccgcaucuaugauaaaaagauacgacgaacaccaccaagaucugacuuuacuuaaagcucuaguucggcagcaacuaccagaaaaauacaaagaaauauucuuugaccaaagcaaaaacggauaugcagguuauauagacggcggcgcgagucaagaagaauuuuauaaauucaucaaaccuauacuugagaaaauggacggcacugaagaacuauuagugaaacuaaauagagaagaucuacuaagaaaacaacgaaccuucgacaauggaagcauaccacaccagauacaccuaggagaacuacacgcgauacuucgccgucaagaagacuucuauccauucuuaaaagauaacagagagaaaauugagaaaauuuuaacauuccgaauaccauacuauguaggaccguuggcuagagguaauucgagauuugcauggaugacaagaaaaucagaagaaacaauaacucccuggaacuuugaagaagucguagacaaaggagcaagugcccaauccuuuauagaaagaaugaccaauuuugacaaaaauuugccaaacgaaaaaguucuccccaaacauucacuucuauacgaauacuuuacuguauacaaugaacuaacaaaaguaaaauacguaacugaaggaaugagaaaaccugccuuccuaucaggggaacagaagaaagcaauaguugaccuacuauuuaaaacaaacagaaaaguuacaguuaaacaacuaaaagaagauuacuuuaagaaaauagaauguuucgacucugucgaaauaucaggaguugaagaucgauucaacgcaaguuugggaacauaccaugauuuauuaaaaauaauaaaagauaaagauuucuuagauaaugaagaaaacgaagauauacuugaagacauaguacuaacacuuacacuauucgaagacagagaaaugauugaagaacggcuaaaaaccuacgcucacuuauuugaugauaaagugaugaaacaauugaaacgaagaagauacacaggauggggacgacuaucaagaaaacuaauuaacgguauaagggacaaacaaucggguaaaaccauccuagacuuucuuaaaagugauggauucgcaaacagaaacuucaugcagcuaauucaugaugacaguuuaacauucaaagaagacauucaaaaagcacaagucuccggacaaggagacagcuugcaugagcauauagcaaaucuugcagggaguccagcaaucaagaaaggaauuuuacaaacuguaaaaguaguagacgagcuagugaaagucaugggucgccacaaacccgaaaauauaguaauagaaauggcgcgagaaaaucaaacaacacaaaaaggucagaaaaauagcagagaaagaaugaaaaggaucgaggaagguauaaaagaauugggcucgcaaauauuaaaagaacauccaguagaaaauacucaacuucaaaacgagaaacuuuacuuauauuaccuacaaaacggaagagauauguauguggaccaagaacucgauauaaaucgucuuucagauuaugaugucgaucacauagugccgcaaucuuuccuaaaagacgauucaaucgauaacaaaguuuuaacaaggagugacaaaaauaggggaaaaucggauaacguaccaucugaagaaguagucaagaaaaugaaaaacuauuggagacaacuacuuaacgcgaaacuaauaacgcagagaaaauuugauaauuugaccaaagcugaaagaggaggauuaagugaacuagauaaagcaggauuuauuaaacgccaauuaguagaaacaagacaaaucacuaaacacguagcacaaauucucgacucaagaaugaacacgaaauacgaugaaaacgauaaacuaauucgagaaguaaagguaaucacacuaaaaucaaaauuaguauccgacuuuagaaaagauuuucaauuuuauaaaguacgagagauaaacaacuaucaccaugcccaugacgccuaucugaacgcugugguaggcacagcacugaucaagaaauacccaaaauuggaaagugaguucguauacggagauuacaagguuuaugauguuaggaagaugaucgcuaaaagcgaacaagaaaucgggaaggccacagcaaaauauuucuuuuauaguaacauuaugaacuucuuuaaaaccgagauaacucuugcaaauggagaaaucaggaagagaccucuaauugaaacgaacggagaaaccggagaaauaguaugggauaaagggcgugauuucgcgacaguacgcaaaguauuauccaugccacaaguaaacauagucaagaaaaccgaaguacaaacuggaggauucagcaaagaaucuauuuuaccaaaaagaaauagugauaaauuaaucgcaagaaagaaagauugggacccgaagaaauauggaggauuugauaguccaacaguagcauauagugugcuuguggucgcaaaaguugaaaagggaaagucuaagaaauuaaaaucaguuaaagaacuacuuggaaucacgaucauggaacgcaguucauuugagaaaaaccccauugacuuucucgaagcaaaaggguauaaagaagucaagaaagaccuaauuaucaaauuaccaaaauacucucucuucgaacuagagaacgguagaaaacggaugcuagcuucagcaggagaacuacaaaaaggcaacgaacucgcauuaccauccaaauacguaaacuuucuauauuuagcgucacauuacgaaaaauuaaaaggaagucccgaagauaacgaacaaaagcaacuauucgucgagcagcacaaacauuacuuagacgagaucaucgaacaaauuagcgaguucucaaagagaguaauacuagcagacgcaaaccuggacaaaguauugagcgcuuauaauaaacauagggauaaaccaaucagagaacaagccgagaauauaauccauuuauucacacuaacaaaucuaggcgccccggcugcauuuaaauacuuugauacaacaauagauagaaaacgcuacaccucaacgaaagagguccuugacgccacauuaauacaccaaucuauaacuggauuguaugagacaagaauagaucuaucccagcugggaggcgacuga
